US007166573B1

(12) United States Patent
Obata

(10) Patent No.: US 7,166,573 B1
(45) Date of Patent: Jan. 23, 2007

(54) BREAST, GASTRIC AND PROSTATE CANCER ASSOCIATED ANTIGENS AND USES THEREFOR

(75) Inventor: Yuichi Obata, Nagoya (JP)

(73) Assignee: Ludwig Institute for Cancer Research, New York, NY (US)

( * ) Notice: Subject to any disclaimer, the term of this patent is extended or adjusted under 35 U.S.C. 154(b) by 0 days.

(21) Appl. No.: 09/979,932

(22) PCT Filed: May 26, 2000

(86) PCT No.: PCT/US00/14749

§ 371 (c)(1),
(2), (4) Date: May 24, 2002

(87) PCT Pub. No.: WO00/73801

PCT Pub. Date: Dec. 7, 2000

Related U.S. Application Data

(60) Provisional application No. 60/153,454, filed on Sep. 10, 1999, provisional application No. 60/136,526, filed on May 28, 1999.

(51) Int. Cl.
*G01N 33/574* (2006.01)
*G01N 33/53* (2006.01)

(52) U.S. Cl. .................. 514/12; 435/7.1; 435/7.23; 435/7.92

(58) Field of Classification Search .............. 435/7.1, 435/7.23, 7.92; 530/350, 387.1
See application file for complete search history.

(56) References Cited

U.S. PATENT DOCUMENTS

| 4,816,567 A | 3/1989 | Cabilly et al. |
| 5,225,539 A | 7/1993 | Winter |
| 5,399,346 A | 3/1995 | Anderson et al. |
| 5,580,723 A | 12/1996 | Wells et al. |
| 5,585,089 A | 12/1996 | Queen et al. |
| 5,693,762 A | 12/1997 | Queen et al. |
| 5,859,205 A | 1/1999 | Adair et al. |

FOREIGN PATENT DOCUMENTS

| WO | WO92/04381 A1 | 3/1992 |
| WO | WO95/00654 A1 | 1/1995 |
| WO | WO96/10577 A1 | 4/1996 |
| WO | WO96/27387 A1 | 9/1996 |
| WO | WO96/33265 A1 | 10/1996 |
| WO | WO96/33739 A1 | 10/1996 |
| WO | WO97/31126 A1 | 8/1997 |
| WO | WO98/32456 A1 | 7/1998 |

OTHER PUBLICATIONS

Scanlan et al.. (Int. J. Cancer: 76, 652-658, 1998).*
Database, EMBL:AF039659, Jun. 2, 1998, "*Homo sapien* antigen NY-CO-25 mRNA", XP002177944.*
Allsopp et al., *Eur. J. Immunol.* 26(8):1951-1959, 1996.
Altman et al., *Science* 274:94-96, 1996.
Bennett et al., *Nature*, 393:478 (1998).
Brichard et al. (*Eur. J. Immunol.* 26:224-230, 1996.
Chen et al. *Proc. Natl. Acad. Sci. USA* 88: 110-114, 1991.
Chen et al., *Proc. Natl. Acad. Sci. USA* 94: 1914 (1997).
Chengalvala et al., *Vaccine* 15:335-339, 1997.
Coulie, *Stem Cells* 13:393-403, 1995.
D'Amaro et al., *Human Immunol.* 43:13-18, 1995.
Dahiyat and Mayo in *Science* 278:82-87, 1997.
Davis et al., *J. Virol.* 70:3781-3787, 1996.
Demoulin *Mol. Cell. Biol.* 16:4710-4716, 1996.
Drijfhout et al., *Human Immunol.* 43:1-12, 1995.
Dunbar et al., *Curr. Biol.* 8:413-416, 1998.
Eloit et al., *J. Virol.* 7:5375-5381, 1997.
Fenton et al., *J. Immunother.,* 21:2:95-108 (1998).
Gajewski et al., *J. Immunol,* 154:5637-5648 (1995).
Gilbert et al., *Nature Biotechnol.* 15(12):1280-1284, 1997.
Greenberg, *J. Immunol.* 136(5): 1917, 1986.
Hall, S.S., et al. *Science* 268(5216): 1432-1434 (1995).
Herin et al., *Int. J. Cancer* 39:390-396, 1987.
Hutloff et al., *Nature* 397:263-266, 1999.
Irwin et al., *J. Virol.* 68:5036-5044, 1994.
Kast et al., *Cell* 59: 603-614, 1989.
Kim J., et al. *Nat Biotechnol.,* 15:7:641-646 (1997).
Knuth et al., *Proc. Natl. Acad. Scil USA* 81:3511-3515, 1984.
Krieg, et al., Nature 374(6522):546-9 (1995).
Kunkel, *Proc. Nat. Acad. Sci. U.S.A.* 82: 488-492, 1985.
Lynch et al, *Eur. J. Immunol.* 21: 1403-1410, 1991.
Manici et al., *J. Exp. Med.* 189:871-876, 1999.
Mishizuma and Nagata *Nuc. Acids Res.* 18:5322, 1990.

(Continued)

*Primary Examiner*—Jeffrey Siew
*Assistant Examiner*—Brandon Fetterolf
(74) *Attorney, Agent, or Firm*—Wolf, Greenfield & Sacks, P.C.

(57) ABSTRACT

Cancer associated antigens have been identified by autologous antibody screening of libraries of nucleic acids expressed in breast, gastric and prostate cancer cells using antisera from cancer patients. The invention relates to nucleic acids and encoded polypeptides which are cancer associated antigens expressed in patients afflicted with cancer. The invention provides, inter alia, isolated nucleic acid molecules, expression vectors containing those molecules and host cells transfected with those molecules. The invention also provides isolated proteins and peptides, antibodies to those proteins and peptides and cytotoxic T lymphocytes which recognize the proteins and peptides. Fragments of the foregoing including functional fragments and variants also are provided. Kits containing the foregoing molecules additionally are provided. The molecules provided by the invention can be used in the diagnosis, monitoring, research, or treatment of conditions characterized by the expression of one or more cancer associated antigens.

12 Claims, No Drawings

OTHER PUBLICATIONS

Moss, *Dev. Biol. Stand.* 82:55-63, 1994.
Moss, *Proc. Natl. Acad. Sci. USA* 93:11341-11348, 1996.
Paoletti, *Proc. Natl. Acad. Sci. USA* 93:11349-11353, 1996.
Parker, et al, *J. Immunol.* 152:163, 1994.
Parra et al., *J. Immunol.,* 158:637-642 (1997).
Pugachev et al., *Virology* 212:587-594, 1995.
Rammensee et al., *Immunogenetics* 41:178-228, 1995.
Riddel et al., *Science* 257:238, (1992).
Ridge et al., *Nature,* 393(6684):474 (1998).
Sahin et al. (*Proc. Natl. Acad. Sci. USA* 92:11810-11813, 1995.
Sainio et al., *Cell Mol. Neurobiol.* 14(5):439-457, 1994.
Schoenberger et al., *Nature,* 393:480 (1998).
So HS et al., *Mol Cells* 1997 Apr. 30:7(2):178-86.
Stratford-Perricaudet, *J. Clin. Invest.* 90:626-630, 1992.
Sturniolo et al., *Nature Biotechnol.* 17:555-561, 1999.
Tam et al., *J. Exp. Med.* 171(1):299-306, 1990.
Thomson et al., *J. Immunol.* 157(2):822-826, 1996.
Thomson et al., *Proc. Acad. Natl. Acad. Sci USA* 92(13):5846-5849, 1995.
Townsend et al., *J. Virol.* 71:3365-3374, 1997.
Van der Bruggen et al., *Eur. J. Immunol.* 24:3038-3043, 1994.
Wagner et al., *Nature Biotechnol.* 14:840-844, 1996.
Warnier et al., *Int. J. Cancer,* 67:303-310, 1996.
Wendtner et al., *Gene Ther.,* 4:7:726-735 (1997).
Xiang et al., *Virology* 219:220-227, (1996).
Zheng P., et al. *Proc. Natl. Acad. Sci. USA* 95 (11):6284-6289 (1998).
Zhuo et al., *Proc. Natl. Acad. Sci. USA* 92(7):3009-3013, (1995).

\* cited by examiner

BREAST, GASTRIC AND PROSTATE CANCER ASSOCIATED ANTIGENS AND USES THEREFOR

RELATED APPLICATIONS

This application is a national stage filing under 35 U.S.C. § 371 of PCT International application PCT/US00/14749, filed May 26, 2000, which was published under PCT Article 21(2) in English. This application claims the benefit under 35 U.S.C. § 119 (e) of U.S. provisional application 60/136,526, filed May 28, 1999, and of U.S. provisional application 60/153,454, filed Sep. 10, 1999.

FIELD OF THE INVENTION

The invention relates to nucleic acids and encoded polypeptides which are cancer associated antigens expressed in patients afflicted with breast, gastric or prostate cancer. The invention also relates to agents which bind the nucleic acids or polypeptides. The nucleic acid molecules, polypeptides coded for by such molecules and peptides derived therefrom, as well as related antibodies and cytolytic T lymphocytes, are useful, inter alia, in diagnostic and therapeutic contexts.

BACKGROUND OF THE INVENTION

The mechanism by which T cells recognize foreign materials has been implicated in cancer. A number of cytolytic T lymphocyte (CTL) clones directed against autologous melanoma antigens, testicular antigens, and melanocyte differentiation antigens have been described. In many instances, the antigens recognized by these clones have been characterized.

The use of autologous CTLs for identifying tumor antigens requires that the target cells which express the antigens can be cultured in vitro and that stable lines of autologous CTL clones which recognize the antigen-expressing cells can be isolated and propagated. While this approach has worked well for melanoma antigens, other tumor types, such as epithelial cancers including breast and colon cancer, have proved refractory to the approach.

More recently another approach to the problem has been described by Sahin et al. (Proc. Natl. Acad. Sci. USA 92:11810–11813, 1995). According to this approach, autologous antisera are used to identify immunogenic protein antigens expressed in cancer cells by screening expression libraries constructed from tumor cell cDNA. Antigen-encoding clones so identified have been found to elicit a high-titer humoral immune response in the patients from which the antisera were obtained. Such a high-titer IgG response implies helper T cell recognition of the detected antigen. These tumor antigens can then be screened for the presence of MHC/HLA class I and class II motifs and reactivity with CTLs.

Since the individual tumor antigens presently known may be expressed only in a fraction of tumors, the availability of additional tumor antigens would significantly enlarge the proportion of patients who are potentially eligible for therapeutic interventions. Thus there presently is a need for additional tumor antigens for development of therapeutics and diagnostics applicable to a greater number of cancer patients having various cancers.

The invention is elaborated upon further in the disclosure which follows.

SUMMARY OF THE INVENTION

Autologous antibody screening has now been applied to breast, gastric and prostate cancer using antisera from cancer patients. Numerous cancer associated antigens have been identified. The invention provides, inter alia, isolated nucleic acid molecules, expression vectors containing those molecules and host cells transfected with those molecules. The invention also provides isolated proteins and peptides, antibodies to those proteins and peptides and CTLs which recognize the proteins and peptides. Fragments including functional fragments and variants of the foregoing also are provided. Kits containing the foregoing molecules additionally are provided. The foregoing can be used in the diagnosis, monitoring, research, or treatment of conditions characterized by the expression of one or more cancer associated antigens.

Prior to the present invention, only a handful of cancer associated genes had been identified in the past 20 years. The invention involves the surprising discovery of several genes, some previously known and some previously unknown, which are expressed in individuals who have cancer. These individuals all have serum antibodies against the proteins (or fragments thereof) encoded by these genes. Thus, abnormally expressed genes are recognized by the host's immune system and therefore can form a basis for diagnosis, monitoring and therapy.

The invention involves the use of a single material, a plurality of different materials and even large panels and combinations of materials. For example, a single gene, a single protein encoded by a gene, a single functional fragment thereof, a single antibody thereto, etc. can be used in methods and products of the invention. Likewise, pairs, groups and even panels of these materials and optionally other cancer associated antigen genes and/or gene products can be used for diagnosis, monitoring and therapy. The pairs, groups or panels can involve 2, 3, 4, 5 or more genes, gene products, fragments thereof or agents that recognize such materials. A plurality of such materials are not only useful in monitoring, typing, characterizing and diagnosing cells abnormally expressing such genes, but a plurality of such materials can be used therapeutically. An example of the use of a plurality of such materials for the prevention, delay of onset, amelioration, etc. of cancer cells, which express or will express such genes prophylactically or acutely. Any and all combinations of the genes, gene products, and materials which recognize the genes and gene products can be tested and identified for use according to the invention. It would be far too lengthy to recite all such combinations; those skilled in the art, particularly in view of the teaching contained herein, will readily be able to determine which combinations are most appropriate for which circumstances.

As will be clear from the following discussion, the invention has in vivo and in vitro uses, including for therapeutic, diagnostic, monitoring and research purposes. One aspect of the invention is the ability to fingerprint a cell expressing a number of the genes identified according to the invention by, for example, quantifying the expression of such gene products. Such fingerprints will be characteristic, for example, of the stage of the cancer, the type of the cancer, or even the effect in animal models of a therapy on a cancer. Cells also can be screened to determine whether such cells abnormally express the genes identified according to the invention.

The invention, in one aspect, is a method of diagnosing a disorder characterized by expression of a cancer associated antigen precursor coded for by a nucleic acid molecule. The method involves the steps of contacting a biological sample isolated from a subject with an agent that specifically binds to the nucleic acid molecule, an expression product thereof, or a fragment of an expression product thereof complexed with an MHC, preferably an HLA, molecule, wherein the nucleic acid molecule is a NA Group 1 nucleic acid molecule, and determining the interaction between the agent and the nucleic acid molecule, the expression product or fragment of the expression product as a determination of the disorder.

In one embodiment the agent is selected from the group consisting of (a) a nucleic acid molecule comprising NA Group 1 nucleic acid molecules or a fragment thereof, (b) a nucleic acid molecule comprising NA Group 3 nucleic acid molecules or a fragment thereof, (c) a nucleic acid molecule comprising NA Group 5 nucleic acid molecules or a fragment thereof, (d) an antibody that binds to an expression product, or a fragment thereof, of NA group 1 nucleic acids, (e) an antibody that binds to an expression product, or a fragment thereof, of NA group 3 nucleic acids, (f) an antibody that binds to an expression product, or a fragment thereof, of NA group 5 nucleic acids, (g) and agent that binds to a complex of an MHC, preferably HLA, molecule and a fragment of an expression product of a NA Group 1 nucleic acid, (h) an agent that binds to a complex of an MHC, preferably HLA, molecule and a fragment of an expression product of a NA group 3 nucleic acid, and (i) an agent that binds to a complex of an MHC, preferably HLA, molecule and a fragment of an expression product of a NA Group 5 nucleic acid.

The disorder may be characterized by expression of a plurality of cancer associated antigen precursors. Thus the methods of diagnosis may include use of a plurality of agents, each of which is specific for a different human cancer associated antigen precursor (including at least one of the cancer associated antigen precursors disclosed herein), and wherein said plurality of agents is at least 2, at least 3, at least 4, at least 5, at least 6, at least 7, at least 8, at least 9 or at least 10 such agents. Any of the diagnostic methods disclosed herein can be applied sequentially over time to permit determination of the prognosis or progression (or regression) of the disorder.

In each of the above embodiments the agent may be specific for a human cancer associated antigen precursor, including the breast, gastric and prostate cancer associated antigen precursors disclosed herein.

In another aspect the invention is a method for determining regression, progression or onset of a condition characterized by expression of abnormal levels of a protein encoded by a nucleic acid molecule that is a NA Group 1 molecule. The method involves the steps of monitoring a sample, from a subject who has or is suspected of having the condition, for a parameter selected from the group consisting of (i) the protein, (ii) a peptide derived from the protein, (iii) an antibody which selectively binds the protein or peptide, and (iv) cytolytic T cells specific for a complex of the peptide derived from the protein and an MHC molecule, as a determination of regression, progression or onset of said condition. In one embodiment the sample is a body fluid, a body effusion or a tissue.

In another embodiment the step of monitoring comprises contacting the sample with a detectable agent selected from the group consisting of (a) an antibody which selectively binds the protein of (i), or the peptide of (ii), (b) a protein or peptide which binds the antibody of (iii), and (c) a cell which presents the complex of the peptide and MHC molecule of (iv). In a preferred embodiment the antibody, the protein, the peptide or the cell is labeled with a radioactive label or an enzyme. The sample in a preferred embodiment is assayed for the peptide. Preferably samples are isolated from tissue or bodily fluids of the subject at sequential time points, and the samples are assayed as a determination of the regression, progression or onset of the condition from a first sequential time point to a second sequential time point.

According to another embodiment the nucleic acid molecule is one of the following: a NA Group 3 molecule or a NA Group 5 molecule. In yet another embodiment the protein is a plurality of proteins, the parameter is a plurality of parameters, each of the plurality of parameters being specific for a different one of the plurality of proteins.

The invention in another aspect is a pharmaceutical preparation for a human subject. The pharmaceutical preparation includes an agent which when administered to the subject enriches selectively the presence of complexes of an HLA molecule and a human cancer associated antigen, and a pharmaceutically acceptable carrier, wherein the human cancer associated antigen is a fragment of a human cancer associated antigen precursor encoded by a nucleic acid molecule which comprises a NA Group 1 molecule. In one embodiment the nucleic acid molecule is a NA Group 3 nucleic acid molecule.

The agent in one embodiment comprises a plurality of agents, each of which enriches selectively in the subject complexes of an HLA molecule and a different human cancer associated antigen. Preferably the plurality is at least two, at least three, at least four or at least 5 different such agents.

In another embodiment the agent is selected from the group consisting of (1) an isolated polypeptide comprising the human cancer associated antigen, or a functional variant thereof, (2) an isolated nucleic acid operably linked to a promoter for expressing the isolated polypeptide, or functional variant thereof, (3) a host cell expressing the isolated polypeptide, or functional variant thereof, and (4) isolated complexes of the polypeptide, or functional variants thereof, and an HLA molecule.

The agent may be a cell expressing an isolated polypeptide. In one embodiment the agent is a cell expressing an isolated polypeptide comprising the human cancer associated antigen or a functional variant thereof. In another embodiment the agent is a cell expressing an isolated polypeptide comprising the human cancer associated antigen or a functional variant thereof, and wherein the cell expresses an HLA molecule that binds the polypeptide. The cell can express one or both of the polypeptide and HLA molecule recombinantly. In preferred embodiments the cell is nonproliferative. In yet another embodiment the agent is at least two, at least three, at least four or at least five different polypeptides, each representing a different human cancer associated antigen or functional variant thereof.

The agent in one embodiment is a PP Group 2 polypeptide. In other embodiments the agent is a PP Group 3 polypeptide or a PP Group 4 polypeptide.

In an embodiment each of the pharmaceutical preparations described herein also includes an adjuvant.

According to another aspect the invention, a composition is provided which includes an isolated agent that binds selectively a PP Group 1 polypeptide. In separate embodiments the agent binds selectively to a polypeptide selected from the following: a PP Group 2 polypeptide, a PP Group 3 polypeptide, a PP Group 4 polypeptide, and a PP Group 5 polypeptide. In other embodiments, the agent is a plurality of different agents that bind selectively at least two, at least three, at least four, or at least five different such polypeptides. In each of the above described embodiments the agent may be an antibody.

In another aspect the invention is a composition of matter composed of a conjugate of the agent of the above-described compositions of the invention and a therapeutic or diagnostic agent. Preferably the conjugate is of the agent and a therapeutic or diagnostic that is an antineoplastic.

The invention in another aspect is a pharmaceutical composition which includes an isolated nucleic acid molecule selected from the group consisting of: (1) NA Group 1 molecules, and (2) NA Group 2 molecules, and a pharmaceutically acceptable carrier. In one embodiment the isolated nucleic acid molecule comprises a NA Group 3 or NA Group 4 molecule. In another embodiment the isolated nucleic acid molecule comprises at least two isolated nucleic acid molecules coding for two different polypeptides, each polypeptide comprising a different cancer associated antigen.

Preferably the pharmaceutical composition also includes an expression vector with a promoter operably linked to the isolated nucleic acid molecule. In another embodiment the pharmaceutical composition also includes a host cell recombinantly expressing the isolated nucleic acid molecule.

According to another aspect of the invention a pharmaceutical composition is provided The pharmaceutical composition includes an isolated polypeptide comprising a PP Group 1 or a PP Group 2 polypeptide, and a pharmaceutically acceptable carrier. In one embodiment the isolated polypeptide comprises a PP Group 3 or a PP Group 4 polypeptide.

In another embodiment the isolated polypeptide comprises at least two different polypeptides, each comprising a different cancer associated antigen at least one of which is encoded by a NA group 1 molecule as disclosed herein. In separate embodiments the isolated polypeptides are selected from the following: breast cancer polypeptides or HLA binding fragments thereof and gastric cancer polypeptides or HLA binding fragments thereof.

In an embodiment each of the pharmaceutical compositions described herein also includes an adjuvant.

Another aspect the invention is an isolated nucleic acid molecule comprising a NA Group 3 molecule. Another aspect the invention is an isolated nucleic acid molecule comprising a NA Group 4 molecule.

The invention in another aspect is an isolated nucleic acid molecule selected from the group consisting of (a) a fragment of a nucleic acid selected from the group of nucleic acid molecules consisting of SEQ ID Nos:1–593, of sufficient length to represent a sequence unique within the human genome, and identifying a nucleic acid encoding a human cancer associated antigen precursor, (b) complements of (a), provided that the fragment includes a sequence of contiguous nucleotides which is not identical to any sequence selected from the sequence group consisting of (1) sequences having the GenBank accession numbers of Table 1 and other sequences publicly available as of the filing date of this application, (2) complements of (1), and (3) fragments of (1) and (2). Preferably the unique fragments are fragments of a nucleic acid selected from the group of nucleic acid molecules consisting of SEQ ID NOs:12, 15, 34–59, 61, 62, 83–95, 186, 190–205, 297, 327–332, and 335–352.

In one embodiment the sequence of contiguous nucleotides is selected from the group consisting of: (1) at least two contiguous nucleotides nonidentical to the sequences in Table 1, (2) at least three contiguous nucleotides nonidentical to the sequences in Table 1, (3) at least four contiguous nucleotides nonidentical to the sequences in Table 1, (4) at least five contiguous nucleotides nonidentical to the sequences in Table 1, (5) at least six contiguous nucleotides nonidentical to the sequences in Table 1, or (6) at least seven contiguous nucleotides nonidentical to the sequences in Table 1.

In another embodiment the fragment has a size selected from the group consisting of at least: 8 nucleotides, 10 nucleotides, 12 nucleotides, 14 nucleotides, 16 nucleotides, 18 nucleotides, 20, nucleotides, 22 nucleotides, 24 nucleotides, 26 nucleotides, 28 nucleotides, 30 nucleotides, 50 nucleotides, 75 nucleotides, 100 nucleotides, 200 nucleotides, 1000 nucleotides and every integer length therebetween.

In yet another embodiment the molecule encodes a polypeptide which, or a fragment of which, binds a human HLA receptor (e.g., class I or class II) or a human antibody.

Another aspect of the invention is an expression vector comprising an isolated nucleic acid molecule of the invention described above operably linked to a promoter.

According to one aspect the invention is an expression vector comprising a nucleic acid operably linked to a promoter, wherein the nucleic acid is a NA Group 1 or Group 2 molecule. In another aspect the invention is an expression vector comprising a NA Group 1 or Group 2 molecule and a nucleic acid encoding an MHC, preferably HLA, molecule.

In yet another aspect the invention is a host cell transformed or transfected with an expression vector of the invention described above.

In another aspect the invention is a host cell transformed or transfected with an expression vector comprising an isolated nucleic acid molecule of the invention described above operably linked to a promoter, or an expression vector comprising a nucleic acid operably linked to a promoter, wherein the nucleic acid is a NA Group 1 or 2 molecule and further comprising a nucleic acid encoding HLA.

According to another aspect of the invention an isolated polypeptide encoded by the isolated nucleic acid molecules of the invention, described above, is provided. These include PP Group 1–5 polypeptides. The invention also includes a fragment of the polypeptide which is immunogenic. In one embodiment the fragment, or a portion of the fragment, binds HLA or a human antibody.

The invention includes in another aspect an isolated fragment of a human cancer associated antigen precursor which, or a portion of which, binds HLA or a human antibody, wherein the precursor is encoded by a nucleic acid molecule that is a NA Group 1 molecule. In one embodiment the fragment is part of a complex with HLA. In another embodiment the fragment is between 8 and 12 amino acids in length. In another embodiment the invention includes an isolated polypeptide comprising a fragment of the polypeptide of sufficient length to represent a sequence unique within the human genome and identifying a polypeptide that is a human cancer associated antigen precursor.

According to another aspect of the invention a kit for detecting the presence of the expression of a cancer associated antigen precursor is provided. The kit includes a pair of isolated nucleic acid molecules each of which consists essentially of a molecule selected from the group consisting of (a) a 12–32 nucleotide contiguous segment of the nucleotide sequence of any of the NA Group 1 molecules and (b) complements of (a), wherein the contiguous segments are nonoverlapping. In one embodiment the pair of isolated nucleic acid molecules is constructed and arranged to selectively amplify an isolated nucleic acid molecule that is a NA Group 3 molecule. Preferably, the pair amplifies a human NA Group 3 molecule.

According to another aspect of the invention a method for treating a subject with a disorder characterized by expression of a human cancer associated antigen precursor is provided. The method includes the step of administering to the subject an amount of an agent, which enriches selectively in the subject the presence of complexes of an HLA molecule and a human cancer associated antigen, effective to ameliorate the disorder, wherein the human cancer associated antigen is a fragment of a human cancer associated antigen precursor encoded by a nucleic acid molecule selected from the group consisting of (a) a nucleic acid molecule comprising NA group 1 nucleic acid molecules, (b) a nucleic acid molecule comprising NA group 3 nucleic acid molecules, (c) a nucleic acid molecule comprising NA group 5 nucleic acid molecules.

In one embodiment the disorder is characterized by expression of a plurality of human cancer associated antigen precursors and wherein the agent is a plurality of agents, each of which enriches selectively in the subject the presence of complexes of an HLA molecule and a different human cancer associated antigen. Preferably the plurality is at least 2, at least 3, at least 4, or at least 5 such agents.

In another embodiment the agent is an isolated polypeptide selected from the group consisting of PP Group 1, PP Group 2, PP Group 3, PP Group 4, and PP group 5 polypeptides.

In yet another embodiment the disorder is cancer.

According to another aspect the invention is a method for treating a subject having a condition characterized by expression of a cancer associated antigen precursor in cells of the subject The method includes the steps of (i) removing an immunoreactive cell containing sample from the subject, (ii) contacting the immunoreactive cell containing sample to the host cell under conditions favoring production of cytolytic T cells against a human cancer associated antigen which is a fragment of the precursor, (iii) introducing the cytolytic T cells to the subject in an amount effective to lyse cells which express the human cancer associated antigen, wherein the host cell is transformed or transfected with an expression vector comprising an isolated nucleic acid molecule operably linked to a promoter, the isolated nucleic acid molecule being selected from the group of nucleic acid molecules consisting of NA Group 1, NA Group 2, NA Group 3, NA Group 4, NA Group 5.

In one embodiment the host cell recombinantly expresses an HLA molecule which binds the human cancer associated antigen. In another embodiment the host cell endogenously expresses an HLA molecule which binds the human cancer associated antigen.

The invention includes in another aspect a method for treating a subject having a condition characterized by expression of a cancer associated antigen precursor in cells of the subject. The method includes the steps of (i) identifying a nucleic acid molecule expressed by the cells associated with said condition, wherein said nucleic acid molecule is a NA Group 1 molecule (ii) transfecting a host cell with a nucleic acid molecule selected from the group consisting of (a) the nucleic acid molecule identified, (b) a fragment of the nucleic acid molecule identified which includes a segment coding for a cancer associated antigen, (c) deletions, substitutions or additions to (a) or (b), and (d) degenerates of (a), (b), or (c); (iii) culturing said transfected host cells to express the transfected nucleic acid molecule, and; (iv) introducing an amount of said host cells or an extract thereof to the subject effective to increase an immune response against the cells of the subject associated with the condition. Preferably, the antigen is a human antigen and the subject is a human.

In one embodiment the method also includes the step of (a) identifying an MHC molecule which presents a portion of an expression product of the nucleic acid molecule, wherein the host cell expresses the same MHC molecule as identified in (a) and wherein the host cell presents an MHC binding portion of the expression product of the nucleic acid molecule.

In another embodiment the method also includes the step of treating the host cells to render them non-proliferative.

In yet another embodiment the immune response comprises a B-cell response or a T cell response. Preferably the response is a T-cell response which comprises generation of cytolytic T-cells specific for the host cells presenting the portion of the expression product of the nucleic acid molecule or cells of the subject expressing the human cancer associated antigen.

In another embodiment the nucleic acid molecule is a NA Group 3 molecule.

Another aspect of the invention is a method for treating or diagnosing or monitoring a subject having a condition characterized by expression of an abnormal amount of a protein encoded by a nucleic acid molecule that is a NA Group I molecule. The method includes the step of administering to the subject an antibody which specifically binds to the protein or a peptide derived therefrom, the antibody being coupled to a therapeutically useful agent, in an amount effective to treat the condition.

In one embodiment the antibody is a monoclonal antibody. Preferably the monoclonal antibody is a chimeric antibody or a humanized antibody.

In another aspect the invention is a method for treating a condition characterized by expression in a subject of abnormal amounts of a protein encoded by a nucleic acid molecule that is a NA Group 1 nucleic acid molecule. The method involves the step of administering to a subject at least one of the pharmaceutical compositions of the invention described above in an amount effective to prevent, delay the onset of, or inhibit the condition in the subject. In one embodiment the condition is cancer. In another embodiment the method includes the step of first identifying that the subject expresses in a tissue abnormal amounts of the protein.

The invention in another aspect is a method for treating a subject having a condition characterized by expression of abnormal amounts of a protein encoded by a nucleic acid molecule that is a NA Group 1 nucleic acid molecule. The method includes the steps of (i) identifying cells from the subject which express abnormal amounts of the protein; (ii) isolating a sample of the cells; (iii) cultivating the cells, and (iv) introducing the cells to the subject in an amount effective to provoke an immune response against the cells.

In one embodiment the method includes the step of rendering the cells non-proliferative, prior to introducing them to the subject.

In another aspect the invention is a method for treating a pathological cell condition characterized by abnormal expression of a protein encoded by a nucleic acid molecule that is a NA Group 1 nucleic acid molecule. The method includes the step of administering to a subject in need thereof an effective amount of an agent which inhibits the expression or activity of the protein.

In one embodiment the agent is an inhibiting antibody which selectively binds to the protein and wherein the antibody is a monoclonal antibody, a chimeric antibody, a humanized antibody or a fragment thereof. In another embodiment the agent is an antisense nucleic acid molecule which selectively binds to the nucleic acid molecule which encodes the protein. In yet another important embodiment the nucleic acid molecule is a NA Group 3 nucleic acid molecule.

The invention includes in another aspect a composition of matter useful in stimulating an immune response to a plurality of proteins encoded by nucleic acid molecules that are NA Group 1 molecules. The composition is a plurality of peptides derived from the amino acid sequences of the proteins, wherein the peptides bind to one or more MHC molecules presented on the surface of the cells which express an abnormal amount of the protein.

In one embodiment at least a portion of the plurality of peptides bind to MHC molecules and elicit a cytolytic response thereto. In another embodiment the composition of matter includes an adjuvant. In another embodiment the adjuvant is a saponin, GM-CSF, or an interleukin. In still another embodiment, the compositions also includes at least one peptide useful in stimulating an immune response to at least one protein which is not encoded by nucleic acid molecules that are NA Group 1 molecules, wherein the at least one peptide binds to one or more MHC molecules.

According to another aspect the invention is an isolated antibody which selectively binds to a complex of: (i) a peptide derived from a protein encoded by a nucleic acid molecule that is a NA Group 1 molecule and (ii) and an MHC molecule to which binds the peptide to form the complex, wherein the isolated antibody does not bind to (i) or (ii) alone.

In one embodiment the antibody is a monoclonal antibody, a chimeric antibody, a humanized antibody or a fragment thereof.

The invention also involves the use of the genes, gene products, fragments thereof, agents which bind thereto, and so on in the preparation of medicaments. A particular medicament is for treating cancers including, e.g., one or more of cancers of the breast, cervix, ovary, prostate, testis, lung, colon, pancreas, stomach, liver, skin (e.g., melanoma), bladder, head and neck, thyroid, blood cells, bone and kidney. Diagnostics for specific cancers and groups of cancers also are envisioned.

In certain preferred embodimenst, the nucleic acid molecules are selected from the group consisting of SEQ ID NOs:1–18, and the polypeptides are encoded by these preferred nucleic acid molecules.

Still other embodiments and aspects of the invention will become apparent in connection with the description of the invention which follows.

DETAILED DESCRIPTION OF THE INVENTION

In the above summary and in the ensuing description, lists of sequences are provided. The lists are meant to embrace each single sequence separately, two or more sequences together where they form a part of the same gene, any combination of two or more sequences which relate to different genes, including and up to the total number on the list, as if each and every combination were separately and specifically enumerated. Likewise, when mentioning fragment size, it is intended that a range embrace the smallest fragment mentioned to the full-length of the sequence (less one nucleotide or amino acid so that it is a fragment), each and every fragment length intended as if specifically enumerated. Thus, if a fragment could be between 10 and 15 in length, it is explicitly meant to mean 10, 11, 12, 13, 14, or 15 in length.

The summary and the claims mention antigen precursors and antigens. As used in the summary and in the claims, a precursor is substantially the full-length protein encoded by the coding region of the isolated DNA and the antigen is a peptide which complexes with MHC, preferably HLA, and which participates in the immune response as part of that complex. Such antigens are typically 9 amino acids long, although this may vary slightly.

As used herein, a subject is a human, non-human primate, cow, horse, pig, sheep, goat, dog, cat or rodent. In all embodiments human cancer antigens and human subjects are preferred.

The present invention in one aspect involves the cloning of cDNAs encoding human cancer associated antigen precursors using autologous antisera of subjects having breast, gastric or prostate cancer. The sequences of the clones representing genes identified according to the methods described herein are presented in the attached Sequence Listing. Of the foregoing, it can be seen that some of the clones are considered completely novel as no coding regions were found in the databases searched. Other clones are novel but have some nucleotide or amino acid homologies to sequences deposited in databases (mainly EST sequences). Nevertheless, the entire gene sequence was not previously known. In some cases no function was suspected and in other cases, even if a function was suspected, it was not known that the gene was associated with cancer, or with a particular cancer. In all cases, it was not known or suspected that the gene encoded a cancer antigen which reacted with an antibody from autologous sera. Analysis of the clone sequences by comparison to nucleic acid and protein databases determined that still other of the clones surprisingly are closely related to other previously-cloned genes. The sequences of these related genes is also presented in the Sequence Listing. The nature of the foregoing genes as encoding antigens recognized by the immune systems of cancer patients is, of course, unexpected.

The invention thus involves in one aspect cancer associated antigen polypeptides, genes encoding those polypeptides, functional modifications and variants of the foregoing, useful fragments of the foregoing, as well as diagnostics and therapeutics relating thereto.

Homologs and alleles of the cancer associated antigen nucleic acids of the invention can be identified by conventional techniques. Thus, an aspect of the invention is those nucleic acid sequences which code for cancer associated antigen precursors. Because this application contains so many sequences, the following chart is provided to identify the various groups of sequences discussed in the claims and in the summary:

Nucleic Acid Sequences

NA Group 1.
(a) nucleic acid molecules which hybridize under stringent conditions to a molecule consisting of a nucleic acid sequence selected from the group consisting of nucleic acid sequences among SEQ ID NOs: 1–593, and which code for a cancer associated antigen precursor,
(b) deletions, additions and substitutions which code for a respective cancer associated antigen precursor, (c) nucleic acid molecules that differ from the nucleic acid molecules of (a) or (b) in codon sequence due to the degeneracy of the genetic code, and (d) complements of (a), (b) or (c).

NA Group 2. Fragments of NA Group 1, which code for a polypeptide which, or a portion of which, binds an MHC molecule to form a complex recognized by an autologous antibody or lymphocyte.

NA Group 3. The subset of NA Group I where the nucleotide sequence is selected from the group consisting of:

(a) previously unknown human nucleic acids coding for a human cancer associated antigen precursor, e.g., SEQ ID NOs:12, 15, 34–59, 61, 62, 83–95, 186, 190–205, 297, 327–332, and 335–352, (b) deletions, additions and substitutions which code for a respective human cancer associated antigen precursor, (c) nucleic acid molecules that differ from the nucleic acid molecules of (a) or (b) in codon sequence due to the degeneracy of the genetic code, and (d) complements of (a), (b) or (c).

NA Group 4. Fragments of NA Group 3, which code for a polypeptide which, or a portion of which, binds to an MHC molecule to form a complex recognized by an autologous antibody or lymphocyte.

NA Group 5. A subset of NA Group 1, comprising human cancer associated antigens that react with allogeneic cancer antisera.

Polypeptide Sequences

PP Group 1. Polypeptides encoded by NA Group 1.

PP Group 2. Polypeptides encoded by NA Group 2.

PP Group 3. Polypeptides encoded by NA Group 3.

PP Group 4. Polypeptides encoded by NA Group 4.

PP Group 5. Polypeptides encoded by NA Group 5.

Particularly preferred polypeptides are those recognized by allogeneic sera of cancer patients, but not by non-cancer patient control sera. For example, as shown in the Examples below, polypeptides encoded by SEQ ID NOs:1–18 are recognized only by antibodies in cancer patients antisera.

The term "stringent conditions" as used herein refers to parameters with which the art is familiar. Nucleic acid hybridization parameters may be found in references which compile such methods, e.g. *Molecular Cloning: A Laboratory Manual*, J. Sambrook, et al., eds., Second Edition, Cold Spring Harbor Laboratory Press, Cold Spring Harbor, N.Y., 1989, or *Current Protocols in Molecular Biology*, F. M. Ausubel, et al., eds., John Wiley & Sons, Inc., New York. More specifically, stringent conditions, as used herein, refers, for example, to hybridization at 65° C. in hybridization buffer (3.5×SSC, 0.02% Ficoll, 0.02% polyvinyl pyrrolidone, 0.02% Bovine Serum Albumin, 2.5 mM $NaH_2PO_4$ (pH7), 0.5% SDS, 2 mM EDTA). SSC is 0.15 M sodium chloride/0.15 M sodium citrate, pH7; SDS is sodium dodecyl sulphate; and EDTA is ethylenediaminetetracetic acid. After hybridization, the membrane upon which the DNA is transferred is washed, for example, in 2×SSC at room temperature and then at 0.1–0.5×SSC/0.1× SDS at temperatures up to 68° C.

There are other conditions, reagents, and so forth which can be used, which result in a similar degree of stringency.

The skilled artisan will be familiar with such conditions, and thus they are not given here. It will be understood, however, that the skilled artisan will be able to manipulate the conditions in a manner to permit the clear identification of homologs and alleles of cancer associated antigen nucleic acids of the invention (e.g., by using lower stringency conditions). The skilled artisan also is familiar with the methodology for screening cells and libraries for expression of such molecules which then are routinely isolated, followed by isolation of the pertinent nucleic acid molecule and sequencing.

In general homologs and alleles typically will share at least 80% nucleotide identity and/or at least 90% amino acid identity to the sequences of cancer associated antigen nucleic acid and polypeptides, respectively, in some instances will share at least 90% nucleotide identity and/or at least 95% amino acid identity and in still other instances will share at least 95% nucleotide identity and/or at least 99% amino acid identity. The homology can be calculated using various, publicly available software tools developed by NCBI (Bethesda, Md.) that can be obtained through the Internet (ncbi.nlm.nih.gov/pub/). Exemplary tools include the BLAST system available at ncbi.nlm.nih.gov, preferably using default settings. Pairwise and ClustalW alignments (BLOSUM30 matrix setting) as well as Kyle-Doolittle hydropathic analysis can be obtained using the MacVector sequence analysis software (Oxford Molecular Group). Watson-Crick complements of the foregoing nucleic acids also are embraced by the invention.

In screening for cancer associated antigen genes, a Southern blot may be performed using the foregoing conditions, together with a radioactive probe. After washing the membrane to which the DNA is finally transferred, the membrane can be placed against X-ray film to detect the radioactive signal. In screening for the expression of cancer associated antigen nucleic acids, Northern blot hybridizations using the foregoing conditions can be performed on samples taken from breast, gastric or prostate cancer patients or subjects suspected of having a condition characterized by expression of the cancer associated antigen genes disclosed herein. Amplification protocols such as polymerase chain reaction using primers which hybridize to the sequences presented also can be used for detection of the cancer associated antigen genes or expression thereof.

The breast, gastric and prostate cancer associated genes correspond to SEQ ID Nos:1–593. These sequences represent genes previously known in humans and genes previously unknown in humans (e.g., SEQ ID NOs:12, 15, 3459, 61, 62, 83–95, 186, 190–205, 297, 327–332, and 335–352). Preferred breast, gastric and prostate cancer associated antigens for the methods of diagnosis disclosed herein are those which encode polypeptides that react with allogeneic cancer antisera (i.e. NA Group 5). Encoded polypeptides (e.g., proteins), peptides and antisera thereto are also preferred for diagnosis.

As used herein with respect to nucleic acids, the term "isolated" means: (i) amplified in vitro by, for example, polymerase chain reaction (PCR); (ii) recombinantly produced by cloning; (iii) purified, as by cleavage and gel separation; or (iv) synthesized by, for example, chemical synthesis. An isolated nucleic acid is one which is readily manipulable by recombinant DNA techniques well known in the art. Thus, a nucleotide sequence contained in a vector in which 5' and 3' restriction sites are known or for which polymerase chain reaction (PCR) primer sequences have been disclosed is considered isolated but a nucleic acid sequence existing in its native state in its natural host is not.

An isolated nucleic acid may be substantially purified, but need not be. For example, a nucleic acid that is isolated within a cloning or expression vector is not pure in that it may comprise only a tiny percentage of the material in the cell in which it resides. Such a nucleic acid is isolated, however, as the term is used herein because it is readily manipulable by standard techniques known to those of ordinary skill in the art. An isolated nucleic acid as used herein is not a naturally occurring chromosome.

As used herein with respect to polypeptides, "isolated" means separated from its native environment and present in sufficient quantity to permit its identification or use. Isolated, when referring to a protein or polypeptide, means, for example: (i) selectively produced by expression cloning or (ii) purified as by chromatography or electrophoresis. Isolated proteins or polypeptides may be, but need not be, substantially pure. The term "substantially pure" means that the proteins or polypeptides are essentially free of other substances with which they may be found in nature or in vivo systems to an extent practical and appropriate for their intended use. Substantially pure polypeptides may be produced by techniques well known in the art. Because an isolated protein may be admixed with a pharmaceutically acceptable carrier in a pharmaceutical preparation, the protein may comprise only a small percentage by weight of the preparation. The protein is nonetheless isolated in that it has been separated from the substances with which it may be associated in living systems, i.e. isolated from other proteins.

The invention also includes degenerate nucleic acids which include alternative codons to those present in the native materials. For example, serine residues are encoded by the codons TCA, AGT, TCC, TCG, TCT and AGC. Each of the six codons is equivalent for the purposes of encoding a serine residue. Thus, it will be apparent to one of ordinary skill in the art that any of the serine-encoding nucleotide triplets may be employed to direct the protein synthesis apparatus, in vitro or in vivo, to incorporate a serine residue into an elongating cancer associated antigen polypeptide. Similarly, nucleotide sequence triplets which encode other amino acid residues include, but are not limited to: CCA, CCC, CCG and CCT (proline codons); CGA, CGC, CGG, CGT, AGA and AGG (arginine codons); ACA, ACC, ACG and ACT (threonine codons); AAC and AAT (asparagine codons); and ATA, ATC and ATT (isoleucine codons). Other amino acid residues may be encoded similarly by multiple nucleotide sequences. Thus, the invention embraces degenerate nucleic acids that differ from the biologically isolated nucleic acids in codon sequence due to the degeneracy of the genetic code.

The invention also provides modified nucleic acid molecules which include additions, substitutions and deletions of one or more nucleotides. In preferred embodiments, these modified nucleic acid molecules and/or the polypeptides they encode retain at least one activity or function of the unmodified nucleic acid molecule and/or the polypeptides, such as antigenicity, enzymatic activity, receptor binding, formation of complexes by binding of peptides by MHC class I and class II molecules, etc. In certain embodiments, the modified nucleic acid molecules encode modified polypeptides, preferably polypeptides having conservative amino acid substitutions as are described elsewhere herein. The modified nucleic acid molecules are structurally related to the unmodified nucleic acid molecules and in preferred embodiments are sufficiently structurally related to the unmodified nucleic acid molecules so that the modified and unmodified nucleic acid molecules hybridize under stringent conditions known to one of skill in the art.

For example, modified nucleic acid molecules which encode polypeptides having single amino acid changes can be prepared. Each of these nucleic acid molecules can have one, two or three nucleotide substitutions exclusive of nucleotide changes corresponding to the degeneracy of the genetic code as described herein. Likewise, modified nucleic acid molecules which encode polypeptides having two amino acid changes can be prepared which have, e.g., 2–6 nucleotide changes. Numerous modified nucleic acid molecules like these will be readily envisioned by one of skill in the art, including for example, substitutions of nucleotides in codons encoding amino acids 2 and 3, 2 and 4, 2 and 5, 2 and 6, and so on. In the foregoing example, each combination of two amino acids is included in the set of modified nucleic acid molecules, as well as all nucleotide substitutions which code for the amino acid substitutions. Additional nucleic acid molecules that encode polypeptides having additional substitutions (i.e., 3 or more), additions or deletions (e.g., by introduction of a stop codon or a splice site(s)) also can be prepared and are embraced by the invention as readily envisioned by one of ordinary skill in the art. Any of the foregoing nucleic acids or polypeptides can be tested by routine experimentation for retention of structural relation or activity to the nucleic acids and/or polypeptides disclosed herein.

The invention also provides isolated unique fragments of cancer associated antigen nucleic acid sequences or complements thereof A unique fragment is one that is a 'signature' for the larger nucleic acid. It, for example, is long enough to assure that its precise sequence is not found in molecules within the human genome outside of the cancer associated antigen nucleic acids defined above (and human alleles). Those of ordinary skill in the art may apply no more than routine procedures to determine if a fragment is unique within the human genome. Unique fragments, however, exclude fragments completely composed of the nucleotide sequences of any of the GenBank accession numbers listed in Table 1 or other previously published sequences as of the filing date of the priority documents for sequences listed in a respective priority document or the filing date of this application for sequences listed for the first time in this application which overlap the sequences of the invention.

A fragment which is completely composed of the sequence described in the foregoing GenBank deposits is one which does not include any of the nucleotides unique to the sequences of the invention. Thus, a unique fragment must contain a nucleotide sequence other than the exact sequence of those in GenBank or fragments thereof. The difference may be an addition, deletion or substitution with respect to the GenBank sequence or it may be a sequence wholly separate from the GenBank sequence.

Unique fragments can be used as probes in Southern and Northern blot assays to identify such nucleic acids, or can be used in amplification assays such as those employing PCR. As known to those skilled in the art, large probes such as 200, 250, 300 or more nucleotides are preferred for certain uses such as Southern and Northern blots, while smaller fragments will be preferred for uses such as PCR. Unique fragments also can be used to produce fusion proteins for generating antibodies or determining binding of the polypeptide fragments, or for generating immunoassay components. Likewise, unique fragments can be employed to produce nonfused fragments of the cancer associated antigen polypeptides, useful, for example, in the preparation of antibodies, and in immunoassays. Unique fragments further can be used as antisense molecules to inhibit the expression of cancer associated antigen nucleic acids and polypeptides, particularly for therapeutic purposes as described in greater detail below. Unique fragments also can be used to create chimeric nucleic acid molecule or polypeptide molecules by, for example, joining all or part of the unique fragment to another nucleic acid or polypeptide molecule (homologous or not). For example, the unique fragment may be similar or identical in large part to a known molecule but may have a portion which is nonidentical to the known molecule; the known molecule and the unique fragment can be used to construct a molecule containing in large part the known molecule with the portion unique to the unique fragment added. Other chimeric molecules will be known to one of ordinary skill in the art and can be prepared using standard molecular biology techniques.

As will be recognized by those skilled in the art, the size of the unique fragment will depend upon its conservancy in the genetic code. Thus, some regions of cancer associated antigen sequences and complements thereof will require longer segments to be unique while others will require only short segments, typically between 12 and 32 nucleotides (e.g. 12, 13, 14, 15, 16, 17, 18, 19, 20, 21, 22, 23, 24, 25, 26, 27, 28, 29, 30, 31 and 32 or more bases long), up to the entire length of the disclosed sequence. As mentioned above, this disclosure intends to embrace each and every fragment of each sequence, beginning at the first nucleotide, the second nucleotide and so on, up to 8 nucleotides short of the end, and ending anywhere from nucleotide number 8, 9, 10 and so on for each sequence, up to the very last nucleotide (provided the sequence is unique as described above).

Virtually any segment of the polypeptide coding region of novel cancer associated antigen nucleic acids, or complements thereof, that is 25 or more nucleotides in length will be unique. Those skilled in the art are well versed in methods for selecting such sequences, typically on the basis of the ability of the unique fragment to selectively distinguish the sequence of interest from other sequences in the human genome of the fragment to those on known databases typically is all that is necessary, although in vitro confirmatory hybridization and sequencing analysis may be performed.

Especially preferred include nucleic acids encoding a series of epitopes, known as "polytopes". The epitopes can be arranged in sequential or overlapping fashion (see, e.g., Thomson et al., *Proc. Natl. Acad. Sci. USA* 92:5845–5849, 1995; Gilbert et al., *Nature Biotechnol.* 15:1280–1284, 1997), with or without the natural flanking sequences, and can be separated by unrelated linker sequences if desired. The polytope is processed to generate individual epitopes which are recognized by the immune system for generation of immune responses.

Thus, for example, peptides derived from a polypeptide having an amino acid sequence encoded by one of the nucleic acid disclosed herein, and which are presented by MHC molecules and recognized by CTL or T helper lymphocytes, can be combined with peptides from one or more other cancer associated antigens (e.g. by preparation of hybrid nucleic acids or polypeptides) to form "polytopes". The two or more peptides (or nucleic acids encoding the peptides) can be selected from those described herein, or they can include one or more peptides of previously known cancer associated antigens. Exemplary cancer associated peptide antigens that can be administered to induce or enhance an immune response are derived from tumor associated genes and encoded proteins including MAGE-A1, MAGE-A2, MAGE-A3, MAGE-A4, MAGE-A5, MAGE-A6, MAGE-A7, MAGE-A8, MAGE-A9, MAGE-A10, MAGE-A11, MAGE-A12, GAGE-1, GAGE-2, GAGE-3, GAGE-4, GAGE-5, GAGE-6, GAGE-7, GAGE-8, GAGE-9, BAGE-1, RAGE-1, LB33/MUM-1, PRAME, NAG, MAGE-B2, MAGE-B3, MAGE-B4, tyrosinase, brain glycogen phosphorylase, Melan-A, MAGE-C1, MAGE-C2, MAGE-C3, MAGE-C4, MAGE-C5, NY-ESO-1, LAGE-1, SSX-1, SSX-2 (HOM-MEL-40), SSX-4, SSX-5, SCP-1 and CT-7. See, for example, PCT application publication no. WO96/10577. Other examples will be known to one of ordinary skill in the art (for example, see Coulie, *Stem Cells* 13:393–403, 1995), and can be used in the invention in a like manner as those disclosed herein. One of ordinary skill in the art can prepare polypeptides comprising one or more peptides and one or more of the foregoing cancer associated peptides, or nucleic acids encoding such polypeptides, according to standard procedures of molecular biology.

Thus polytopes are groups of two or more potentially immunogenic or immune response stimulating peptides which can be joined together in various arrangements (e.g. concatenated, overlapping). The polytope (or nucleic acid encoding the polytope) can be administered in a standard immunization protocol, e.g. to animals, to test the effectiveness of the polytope in stimulating, enhancing and/or provoking an immune response.

The peptides can be joined together directly or via the use of flanking sequences to form polytopes, and the use of polytopes as vaccines is well known in the art (see, e.g., Thomson et al., *Proc. Acad. Natl. Acad. Sci USA* 92(13): 5845–5849, 1995; Gilbert et al., *Nature Biotechnol.* 15(12): 1280–1284, 1997; Thomson et al., *J. Immunol.* 157(2): 822–826, 1996; Tam et al., *J. Exp. Med.* 171(1):299–306, 1990). For example, Tam showed that polytopes consisting of both MHC class I and class II binding epitopes successfully generated antibody and protective immunity in a mouse model. Tam also demonstrated that polytopes comprising "strings" of epitopes are processed to yield individual epitopes which are presented by MHC molecules and recognized by CTLs. Thus polytopes containing various numbers and combinations of epitopes can be prepared and tested for recognition by CTLs and for efficacy in increasing an immune response.

It is known that tumors express a set of tumor antigens, of which only certain subsets may be expressed in the tumor of any given patient. Polytopes can be prepared which correspond to the different combination of epitopes representing the subset of tumor rejection antigens expressed in a particular patient. Polytopes also can be prepared to reflect a broader spectrum of tumor rejection antigens known to be expressed by a tumor type. Polytopes can be introduced to a patient in need of such treatment as polypeptide structures, or via the use of nucleic acid delivery systems known in the art (see, e.g., Allsopp et al., *Eur. J. Immunol.* 26(8):1951–1959, 1996). Adenovirus, pox virus, Ty-virus like particles, adeno-associated virus, plasmids, bacteria, etc. can be used in such delivery. One can test the polytope delivery systems in mouse models to determine efficacy of the delivery system. The systems also can be tested in human clinical trials.

In instances in which a human HLA class I molecule presents tumor rejection antigens derived from cancer associated nucleic acids, the expression vector may also include a nucleic acid sequence coding for the HLA molecule that presents any particular tumor rejection antigen derived from these nucleic acids and polypeptides. Alternatively, the nucleic acid sequence coding for such a HLA molecule can be contained within a separate expression vector. In a situation where the vector contains both coding sequences, the single vector can be used to transfect a cell which does not normally express either one. Where the coding sequences for a cancer associated antigen precursor and the HLA molecule which presents it are contained on separate expression vectors, the expression vectors can be cotransfected. The cancer associated antigen precursor coding sequence may be used alone, when, e.g. the host cell already expresses a HLA molecule which presents a cancer associated antigen derived from precursor molecules. Of course, there is no limit on the particular host cell which can be used. As the vectors which contain the two coding sequences may be used in any antigen-presenting cells if desired, and the gene for cancer associated antigen precursor can be used in host cells which do not express a HLA molecule which presents a cancer associated antigen. Further, cell-free transcription systems may be used in lieu of cells.

As mentioned above, the invention embraces antisense oligonucleotides that selectively bind to a nucleic acid molecule encoding a cancer associated antigen polypeptide, to reduce the expression of cancer associated antigens. This is desirable in virtually any medical condition wherein a reduction of expression of cancer associated antigens is desirable, e.g., in the treatment of cancer. This is also useful for in vitro or in vivo testing of the effects of a reduction of expression of one or more cancer associated antigens.

As used herein, the term "antisense oligonucleotide" or "antisense" describes an oligonucleotide that is an oligoribonucleotide, oligodeoxyribonucleotide, modified oligoribonucleotide, or modified oligodeoxyribonucleotide which hybridizes under physiological conditions to DNA comprising a particular gene or to an mRNA transcript of that gene and, thereby, inhibits the transcription of that gene and/or the translation of that mRNA. The antisense molecules are designed so as to interfere with transcription or translation of a target gene upon hybridization with the target gene or transcript. Those skilled in the art will recognize that the exact length of the antisense oligonucleotide and its degree of complementarity with its target will depend upon the specific target selected, including the sequence of the target and the particular bases which comprise that sequence. It is preferred that the antisense oligonucleotide be constructed and arranged so as to bind selectively with the target under physiological conditions, i.e., to hybridize substantially more to the target sequence than to any other sequence in the target cell under physiological conditions. Based upon the sequences of nucleic acids encoding breast, gastric or prostate cancer associated antigens, or upon allelic or homologous genomic and/or cDNA sequences, one of skill in the art can easily choose and synthesize any of a number of appropriate antisense molecules for use in accordance with the present invention. For example, a "gene walk" comprising a series of oligonucleotides of 15–30 nucleotides spanning the length of a cancer associated antigen can be prepared, followed by testing for inhibition of cancer associated antigen expression. Optionally, gaps of 5–10 nucleotides can be left between the oligonucleotides to reduce the number of oligonucleotides synthesized and tested.

In order to be sufficiently selective and potent for inhibition, such antisense oligonucleotides should comprise at least 10 and, more preferably, at least 15 consecutive bases which are complementary to the target, although in certain cases modified oligonucleotides as short as 7 bases in length have been used successfully as antisense oligonucleotides (Wagner et al., *Nature Biotechnol.* 14:840–844, 1996). Most preferably, the antisense oligonucleotides comprise a complementary sequence of 20–30 bases. Although oligonucleotides may be chosen which are antisense to any region of the gene or mRNA transcripts, in preferred embodiments the antisense oligonucleotides correspond to N-terminal or 5' upstream sites such as translation initiation, transcription initiation or promoter sites. In addition, 3'-untranslated regions may be targeted. Targeting to mRNA splicing sites has also been used in the art but may be less preferred if alternative mRNA splicing occurs. In addition, the antisense is targeted, preferably, to sites in which mRNA secondary structure is not expected (see, e.g., Sainio et al., *Cell Mol. Neurobiol.* 14(5):439–457, 1994) and at which proteins are not expected to bind. Finally, although the listed sequences are cDNA sequences, one of ordinary skill in the art may easily derive the genomic DNA corresponding to the cDNA of a cancer associated antigen. Thus, the present invention also provides for antisense oligonucleotides which are complementary to the genomic DNA corresponding to nucleic acids encoding cancer associated antigens. Similarly, antisense to allelic or homologous cDNAs and genomic DNAs are enabled without undue experimentation.

In one set of embodiments, the antisense oligonucleotides of the invention may be composed of "natural" deoxyribonucleotides, ribonucleotides, or any combination thereof. That is, the 5' end of one native nucleotide and the 3' end of another native nucleotide may be covalently linked, as in natural systems, via a phosphodiester internucleoside linkage. These oligonucleotides may be prepared by art recognized methods which may be carried out manually or by an automated synthesizer. They also may be produced recombinantly by vectors.

In preferred embodiments, however, the antisense oligonucleotides of the invention also may include "modified" oligonucleotides. That is, the oligonucleotides may be modified in a number of ways which do not prevent them from hybridizing to their target but which enhance their stability or targeting or which otherwise enhance their therapeutic effectiveness.

The term "modified oligonucleotide" as used herein describes an oligonucleotide in which (1) at least two of its nucleotides are covalently linked via a synthetic internucleoside linkage (i.e., a linkage other than a phosphodiester linkage between the 5' end of one nucleotide and the 3' end of another nucleotide) and/or (2) a chemical group not normally associated with nucleic acids has been covalently attached to the oligonucleotide. Preferred synthetic internucleoside linkages are phosphorothioates, alkylphosphonates, phosphorodithioates, phosphate esters, alkylphosphonothioates, phosphoramidates, carbamates, carbonates, phosphate triesters, acetamidates, carboxymethyl esters and peptides.

The term "modified oligonucleotide" also encompasses oligonucleotides with a covalently modified base and/or sugar. For example, modified oligonucleotides include oligonucleotides having backbone sugars which are covalently attached to low molecular weight organic groups other than a hydroxyl group at the 3' position and other than a phosphate group at the 5' position. Thus modified oligonucleotides may include a 2'-O-alkylated ribose group. In addition, modified oligonucleotides may include sugars such as arabinose instead of ribose. The present invention, thus, contemplates pharmaceutical preparations containing modified antisense molecules that are complementary to and hybridizable with, under physiological conditions, nucleic acids encoding breast, gastric or prostate cancer associated antigen polypeptides, together with pharmaceutically acceptable carriers.

Antisense oligonucleotides may be administered as part of a pharmaceutical composition. Such a pharmaceutical composition may include the antisense oligonucleotides in combination with any standard physiologically and/or pharmaceutically acceptable carriers which are known in the art. The compositions should be sterile and contain a therapeutically effective amount of the antisense oligonucleotides in a unit of weight or volume suitable for administration to a patient. The term "pharmaceutically acceptable" means a non-toxic material that does not interfere with the effectiveness of the biological activity of the active ingredients. The term "physiologically acceptable" refers to a non-toxic material that is compatible with a biological system such as a cell, cell culture, tissue, or organism. The characteristics of the carrier will depend on the route of administration. Physiologically and pharmaceutically acceptable carriers include diluents, fillers, salts, buffers, stabilizers, solubilizers, and other materials which are well known in the art, as further described below.

As used herein, a "vector" may be any of a number of nucleic acids into which a desired sequence may be inserted by restriction and ligation for transport between different genetic environments or for expression in a host cell. Vectors are typically composed of DNA although RNA vectors are also available. Vectors include, but are not limited to, plasmids, phagemids and virus genomes. A cloning vector is one which is able to replicate autonomously or integrated in the genome in a host cell, and which is further characterized by one or more endonuclease restriction sites at which the vector may be cut in a determinable fashion and into which a desired DNA sequence may be ligated such that the new recombinant vector retains its ability to replicate in the host cell. In the case of plasmids, replication of the desired sequence may occur many times as the plasmid increases in copy number within the host bacterium or just a single time per host before the host reproduces by mitosis. In the case of phage, replication may occur actively during a lytic phase or passively during a lysogenic phase. An expression vector is one into which a desired DNA sequence may be inserted by restriction and ligation such that it is operably joined to regulatory sequences and may be expressed as an RNA transcript. Vectors may further contain one or more marker sequences suitable for use in the identification of cells which have or have not been transformed or transfected with the vector. Markers include, for example, genes encoding proteins which increase or decrease either resistance or sensitivity to antibiotics or other compounds, genes which encode enzymes whose activities are detectable by standard assays known in the art (e.g., β-galactosidase, luciferase or alkaline phosphatase), and genes which visibly affect the phenotype of transformed or transfected cells, hosts, colonies or plaques (e.g., green fluorescent protein). Preferred vectors are those capable of autonomous replication and expression of the structural gene products present in the DNA segments to which they are operably joined.

As used herein, a coding sequence and regulatory sequences are said to be "operably" joined when they are covalently linked in such a way as to place the expression or transcription of the coding sequence under the influence or control of the regulatory sequences. If it is desired that the coding sequences be translated into a functional protein, two DNA sequences are said to be operably joined if induction of a promoter in the 5' regulatory sequences results in the transcription of the coding sequence and if the nature of the linkage between the two DNA sequences does not (1) result in the introduction of a frame-shift mutation, (2) interfere with the ability of the promoter region to direct the transcription of the coding sequences, or (3) interfere with the ability of the corresponding RNA transcript to be translated into a protein. Thus, a promoter region would be operably joined to a coding sequence if the promoter region were capable of effecting transcription of that DNA sequence such that the resulting transcript might be translated into the desired protein or polypeptide.

The precise nature of the regulatory sequences needed for gene expression may vary between species or cell types, but shall in general include, as necessary, 5' non-transcribed and 5' non-translated sequences involved with the initiation of transcription and translation respectively, such as a TATA box, capping sequence, CAAT sequence, and the like. Especially, such 5' non-transcribed regulatory sequences will include a promoter region which includes a promoter sequence for transcriptional control of the operably joined gene. Regulatory sequences may also include enhancer sequences or upstream activator sequences as desired. The vectors of the invention may optionally include 5' leader or signal sequences. The choice and design of an appropriate vector is within the ability and discretion of one of ordinary skill in the art.

Expression vectors containing all the necessary elements for expression are commercially available and known to those skilled in the art. See, e.g., Sambrook et al., *Molecular Cloning: A Laboratory Manual*, Second Edition, Cold Spring Harbor Laboratory Press, 1989. Cells are genetically engineered by the introduction into the cells of heterologous DNA (RNA) encoding a cancer associated antigen polypeptide or fragment or variant thereof. That heterologous DNA (RNA) is placed under operable control of transcriptional elements to permit the expression of the heterologous DNA in the host cell.

Preferred systems for mRNA expression in mammalian cells are those such as pRc/CMV (available from Invitrogen, Carlsbad, Calif.) that contain a selectable marker such as a gene that confers G418 resistance (which facilitates the selection of stably transfected cell lines) and the human cytomegalovirus (CMV) enhancer-promoter sequences. Additionally, suitable for expression in primate or canine cell lines is the pCEP4 vector (Invitrogen), which contains an Epstein Barr Virus (EBV) origin of replication, facilitating the maintenance of plasmid as a multicopy extrachromosomal element. Another expression vector is the pEF-BOS plasmid containing the promoter of polypeptide Elongation Factor 1α, which stimulates efficiently transcription in vitro. The plasmid is described by Mishizuma and Nagata (*Nuc. Acids Res.* 18:5322, 1990), and its use in transfection experiments is disclosed by, for example, Demoulin (*Mol. Cell. Biol.* 16:4710–4716, 1996). Still another preferred expression vector is an adenovirus, described by Stratford-Perricaudet, which is defective for E1 and E3 proteins (*J. Clin. Invest.* 90:626–630, 1992). The use of the adenovirus as an Adeno.P1A recombinant for the expression of an antigen is disclosed by Warnier et al., in intradermal injection in mice for immunization against P1A (*Int. J. Cancer*, 67:303–310, 1996). Additional vectors for delivery of nucleic acid are provided below.

The invention also embraces so-called expression kits, which allow the artisan to prepare a desired expression vector or vectors. Such expression kits include at least separate portions of a vector and one or more of the previously discussed cancer associated antigen nucleic acid molecules. Other components may be added, as desired, as long as the previously mentioned nucleic acid molecules, which are required, are included. The invention also includes kits for amplification of a cancer associated antigen nucleic acid, including at least one pair of amplification primers which hybridize to a cancer associated antigen nucleic acid. The primers preferably are 12–32 nucleotides in length and are non-overlapping to prevent formation of "primer-dimers". One of the primers will hybridize to one strand of the cancer associated antigen nucleic acid and the second primer will hybridize to the complementary strand of the cancer associated antigen nucleic acid, in an arrangement which permits amplification of the cancer associated antigen nucleic acid. Selection of appropriate primer pairs is standard in the art. For example, the selection can be made with assistance of a computer program designed for such a purpose, optionally followed by testing the primers for amplification specificity and efficiency.

The invention also permits the construction of cancer associated antigen gene "knock-outs" and transgenic overexpression in cells and in animals, providing materials for studying certain aspects of cancer and immune system responses to cancer.

The invention also provides isolated polypeptides (including whole proteins and partial proteins) encoded by the foregoing cancer associated antigen nucleic acids. Such polypeptides are useful, for example, alone or as fusion proteins to generate antibodies, as components of an immunoassay or diagnostic assay or as therapeutics. Cancer associated antigen polypeptides can be isolated from biological samples including tissue or cell homogenates, and can also be expressed recombinantly in a variety of prokaryotic and eukaryotic expression systems by constructing an expression vector appropriate to the expression system, introducing the expression vector into the expression system, and isolating the recombinantly expressed protein. Short polypeptides, including antigenic peptides (such as are presented by MHC molecules on the surface of a cell for immune recognition) also can be synthesized chemically using well-established methods of peptide synthesis.

A unique fragment of a cancer associated antigen polypeptide, in general, has the features and characteristics of unique fragments as discussed above in connection with nucleic acids. As will be recognized by those skilled in the art, the size of the unique fragment will depend upon factors such as whether the fragment constitutes a portion of a conserved protein domain. Thus, some regions of cancer associated antigens will require longer segments to be unique while others will require only short segments, typically between 5 and 12 amino acids (e.g. 5, 6, 7, 8, 9, 10, 11 or 12 or more amino acids including each integer up to the full length).

Unique fragments of a polypeptide preferably are those fragments which retain a distinct functional capability of the polypeptide. Functional capabilities which can be retained in a unique fragment of a polypeptide include interaction with antibodies, interaction with other polypeptides or fragments thereof, selective binding of nucleic acids or proteins, and enzymatic activity. One important activity is the ability to act as a signature for identifying the polypeptide. Another is the ability to complex with HLA and to provoke in a human an immune response. Those skilled in the art are well versed in methods for selecting unique amino acid sequences, typically on the basis of the ability of the unique fragment to selectively distinguish the sequence of interest from non-family members. A comparison of the sequence of the fragment to those on known databases typically is all that is necessary.

The invention embraces variants of the cancer associated antigen polypeptides described above. As used herein, a "variant" of a cancer associated antigen polypeptide is a polypeptide which contains one or more modifications to the primary amino acid sequence of a cancer associated antigen polypeptide. Modifications which create a cancer associated antigen variant can be made to a cancer associated antigen polypeptide 1) to reduce or eliminate an activity of a cancer associated antigen polypeptide; 2) to enhance a property of a cancer associated antigen polypeptide, such as protein stability in an expression system or the stability of protein—protein binding; 3) to provide a novel activity or property to a cancer associated antigen polypeptide, such as addition of an antigenic epitope or addition of a detectable moiety, or 4) to provide equivalent or better binding to an HLA molecule. Modifications to a cancer associated antigen polypeptide are typically made to the nucleic acid which encodes the cancer associated antigen polypeptide, and can include deletions, point mutations, truncations, amino acid substitutions and additions of amino acids or non-amino acid moieties. Alternatively, modifications can be made directly to the polypeptide, such as by cleavage, addition of a linker molecule, addition of a detectable moiety, such as biotin, addition of a fatty acid, substitution of L-amino acids with D-amino acids, and the like. Modifications also embrace fusion proteins comprising all or part of the cancer associated antigen amino acid sequence. One of skill in the art will be familiar with methods for predicting the effect on protein conformation of a change in protein sequence, and can thus "design" a variant cancer associated antigen polypeptide according to known methods. One example of such a method is described by Dahiyat and Mayo in *Science* 278:82–87, 1997, whereby proteins can be designed de novo. The method can be applied to a known protein to vary a only a portion of the polypeptide sequence. By applying the computational methods of Dahiyat and Mayo, specific variants of a cancer associated antigen polypeptide can be proposed and tested to determine whether the variant retains a desired conformation. Other computational and computer modeling methods for designing polypeptide mimetics which retain activity of the polypeptides described herein, as well as selection methods such as phage display of peptide libraries are known in the art.

In general, variants include cancer associated antigen polypeptides which are modified specifically to alter a feature of the polypeptide unrelated to its desired physiological activity. For example, cysteine residues can be substituted or deleted to prevent unwanted disulfide linkages. Similarly, certain amino acids can be changed to enhance expression of a cancer associated antigen polypeptide by eliminating proteolysis by proteases in an expression system (e.g., dibasic amino acid residues in yeast expression systems in which KEX2 protease activity is present).

Mutations of a nucleic acid which encode a cancer associated antigen polypeptide preferably preserve the amino acid reading frame of the coding sequence, and preferably do not create regions in the nucleic acid which are likely to hybridize to form secondary structures, such a hairpins or loops, which can be deleterious to expression of the variant polypeptide.

Mutations can be made by selecting an amino acid substitution, or by random mutagenesis of a selected site in a nucleic acid which encodes the polypeptide. Variant polypeptides are then expressed and tested for one or more activities to determine which mutation provides a variant polypeptide with the desired properties. Further mutations can be made to variants (or to non-variant cancer associated antigen polypeptides) which are silent as to the amino acid sequence of the polypeptide, but which provide preferred codons for translation in a particular host. The preferred codons for translation of a nucleic acid in, e.g., *E. coli*, are well known to those of ordinary skill in the art. Still other mutations can be made to the noncoding sequences of a cancer associated antigen gene or cDNA clone to enhance expression of the polypeptide. The activity of variants of cancer associated antigen polypeptides can be tested by cloning the gene encoding the variant cancer associated antigen polypeptide into a bacterial or mammalian expression vector, introducing the vector into an appropriate host cell, expressing the variant cancer associated antigen polypeptide, and testing for a functional capability of the cancer associated antigen polypeptides as disclosed herein. For example, the variant cancer associated antigen polypeptide can be tested for reaction with autologous or allogeneic sera as disclosed in the Examples. Preparation of other variant polypeptides may favor testing of other activities, as will be known to one of ordinary skill in the art.

The skilled artisan will also realize that conservative amino acid substitutions may be made in cancer associated antigen polypeptides to provide functionally equivalent variants of the foregoing polypeptides, i.e, the variants retain the functional capabilities of the cancer associated antigen polypeptides. As used herein, a "conservative amino acid substitution" refers to an amino acid substitution which does not alter the relative charge or size characteristics of the protein in which the amino acid substitution is made. Variants can be prepared according to methods for altering polypeptide sequence known to one of ordinary skill in the art such as are found in references which compile such methods, e.g. *Molecular Cloning: A Laboratory Manual*, J. Sambrook, et al., eds., Second Edition, Cold Spring Harbor Laboratory Press, Cold Spring Harbor, N.Y., 1989, or *Current Protocols in Molecular Biology*, F. M. Ausubel, et al., eds., John Wiley & Sons, Inc., New York. Exemplary functionally equivalent variants of the cancer associated antigen polypeptides include conservative amino acid substitutions of in the amino acid sequences of proteins disclosed herein. Conservative substitutions of amino acids include substitutions made amongst amino acids within the following groups: (a) M, I, L, V; (b) F, Y, W; (c) K, R, H; (d) A, G; (e) S, T; (f) Q, N; and (g) E, D.

For example, upon determining that a peptide derived from a cancer associated antigen polypeptide is presented by an MHC molecule and recognized by CTLs, one can make conservative amino acid substitutions to the amino acid sequence of the peptide, particularly at residues which are thought not to be direct contact points with the MHC molecule. For example, methods for identifying functional variants of HLA class II binding peptides are provided in a published PCT application of Strominger and Wucherpfennig (PCT/US96/03182). Peptides bearing one or more amino acid substitutions also can be tested for concordance with known HLA/MHC motifs prior to synthesis using, e.g. the computer program described by D'Amaro and Drijfhout (D'Amaro et al., *Human Immunol.* 43:13–18, 1995; Drijfhout et al., *Human Immunol.* 43:1–12, 1995). The substituted peptides can then be tested for binding to the MHC molecule and recognition by CTLs when bound to MHC. These variants can be tested for improved stability and are useful, inter alia, in vaccine compositions.

Conservative amino-acid substitutions in the amino acid sequence of cancer associated antigen polypeptides to produce functionally equivalent variants of cancer associated antigen polypeptides typically are made by alteration of a nucleic acid encoding a cancer associated antigen polypeptide. Such substitutions can be made by a variety of methods known to one of ordinary skill in the art. For example, amino acid substitutions may be made by PCR-directed mutation, site-directed mutagenesis according to the method of Kunkel (Kunkel, *Proc. Nat. Acad. Sci. U.S.A.* 82: 488–492, 1985), or by chemical synthesis of a gene encoding a cancer associated antigen polypeptide. Where amino acid substitutions are made to a small unique fragment of a cancer associated antigen polypeptide, such as an antigenic epitope recognized by autologous or allogeneic sera or cytolytic T lymphocytes, the substitutions can be made by directly synthesizing the peptide. The activity of functionally equivalent fragments of cancer associated antigen polypeptides can be tested by cloning the gene encoding the altered cancer associated antigen polypeptide into a bacterial or mammalian expression vector, introducing the vector into an appropriate host cell, expressing the altered cancer associated antigen polypeptide, and testing for a functional capability of the cancer associated antigen polypeptides as disclosed herein. Peptides which are chemically synthesized can be tested directly for function, e.g., for binding to antisera recognizing associated antigens.

The invention as described herein has a number of uses, some of which are described elsewhere herein. First, the invention permits production and/or isolation of the cancer associated antigen protein molecules. A variety of methodologies well-known to the skilled practitioner can be utilized to obtain isolated cancer associated antigen molecules. The polypeptide may be purified from cells which naturally produce the polypeptide by chromatographic means or immunological recognition. Alternatively, an expression vector may be introduced into cells to cause production of the polypeptide. In another method, mRNA transcripts may be microinjected or otherwise introduced into cells to cause production of the encoded polypeptide. Translation of mRNA in cell-free extracts such as the reticulocyte lysate system also may be used to produce polypeptide. Those skilled in the art also can readily follow known methods for isolating cancer associated antigen polypeptides. These include, but are not limited to, immunochromatography, HPLC, size-exclusion chromatography, ion-exchange chromatography and immune-affinity chromatography.

The isolation and identification of cancer associated antigen genes also makes it possible for the artisan to diagnose a disorder characterized by expression of cancer associated antigens. These methods involve determining expression of one or more cancer associated antigen nucleic acids, and/or encoded cancer associated antigen polypeptides and/or peptides derived therefrom. In the former situation, such determinations can be carried out via any standard nucleic acid determination assay, including the polymerase chain reaction, or assaying with labeled hybridization probes. In the latter situation, such determinations can be carried out by screening patient antisera for recognition of the polypeptide.

The invention also makes it possible isolate proteins which bind to cancer associated antigens as disclosed herein, including antibodies and cellular binding partners of the cancer associated antigens. Additional uses are described further herein.

The invention also provides, in certain embodiments, "dominant negative" polypeptides derived from cancer associated antigen polypeptides. A dominant negative polypeptide is an inactive variant of a protein, which, by interacting with the cellular machinery, displaces an active protein from its interaction with the cellular machinery or competes with the active protein, thereby reducing the effect of the active protein. For example, a dominant negative receptor which binds a ligand but does not transmit a signal in response to binding of the ligand can reduce the biological effect of expression of the ligand. Likewise, a dominant negative catalytically-inactive kinase which interacts normally with target proteins but does not phosphorylate the target proteins can reduce phosphorylation of the target proteins in response to a cellular signal. Similarly, a dominant negative transcription factor which binds to a promoter site in the control region of a gene but does not increase gene transcription can reduce the effect of a normal transcription factor by occupying promoter binding sites without increasing transcription.

The end result of the expression of a dominant negative polypeptide in a cell is a reduction in function of active proteins. One of ordinary skill in the art can assess the potential for a dominant negative variant of a protein, and using standard mutagenesis techniques to create one or more dominant negative variant polypeptides. For example, given the teachings contained herein of breast, gastric and prostate cancer associated antigens, especially those which are similar to known proteins which have known activities, one of ordinary skill in the art can modify the sequence of the cancer associated antigens by site-specific mutagenesis, scanning mutagenesis, partial gene deletion or truncation, and the like. See, e.g., U.S. Pat. No. 5,580,723 and Sambrook et al., *Molecular Cloning: A Laboratory Manual*, Second Edition, Cold Spring Harbor Laboratory Press, 1989. The skilled artisan then can test the population of mutagenized polypeptides for diminution in a selected and/or for retention of such an activity. Other similar methods for creating and testing dominant negative variants of a protein will be apparent to one of ordinary skill in the art.

The invention also involves agents such as polypeptides which bind to cancer associated antigen polypeptides. Such binding agents can be used, for example, in screening assays to detect the presence or absence of cancer associated antigen polypeptides and complexes of cancer associated antigen polypeptides and their binding partners and in purification protocols to isolated cancer associated antigen polypeptides and complexes of cancer associated antigen polypeptides and their binding partners. Such agents also can be used to inhibit the native activity of the cancer associated antigen polypeptides, for example, by binding to such polypeptides.

The invention, therefore, embraces peptide binding agents which, for example, can be antibodies or fragments of antibodies having the ability to selectively bind to cancer associated antigen polypeptides. Antibodies include polyclonal and monoclonal antibodies, prepared according to conventional methodology.

Significantly, as is well-known in the art, only a small portion of an antibody molecule, the paratope, is involved in the binding of the antibody to its epitope (see, in general, Clark, W. R. (1986) *The Experimental Foundations of Modern Immunology* Wiley & Sons, Inc., New York; Roitt, I. (1991) *Essential Immunology*. 7th Ed., Blackwell Scientific Publications, Oxford). The pFc' and Fc regions, for example, are effectors of the complement cascade but are not involved in antigen binding. An antibody from which the pFc' region has been enzymatically cleaved, or which has been produced without the pFc' region, designated an $F(ab')_2$ fragment, retains both of the antigen binding sites of an intact antibody. Similarly, an antibody from which the Fc region has been enzymatically cleaved, or which has been produced without the Fc region, designated an Fab fragment, retains one of the antigen binding sites of an intact antibody molecule. Proceeding further, Fab fragments consist of a covalently bound antibody light chain and a portion of the antibody heavy chain denoted Fd. The Fd fragments are the major determinant of antibody specificity (a single Fd fragment may be associated with up to ten different light chains without altering antibody specificity) and Fd fragments retain epitope-binding ability in isolation.

Within the antigen-binding portion of an antibody, as is well-known in the art, there are complementarity determining regions (CDRs), which directly interact with the epitope of the antigen, and framework regions (FRs), which maintain the tertiary structure of the paratope (see, in general, Clark, 1986; Roitt, 1991). In both the heavy chain Fd fragment and the light chain of IgG immunoglobulins, there are four framework regions (FR1 through FR4) separated respectively by three complementarity determining regions (CDR1 through CDR3). The CDRs, and in particular the CDR3 regions, and more particularly the heavy chain CDR3, are largely responsible for antibody specificity.

It is now well-established in the art that the non-CDR regions of a mammalian antibody may be replaced with similar regions of conspecific or heterospecific antibodies while retaining the epitopic specificity of the original antibody. This is most clearly manifested in the development and use of "humanized" antibodies in which non-human CDRs are covalently joined to human FR and/or Fc/pFc' regions to produce a functional antibody. See, e.g., U.S. Pat. Nos. 4,816,567, 5,225,539, 5,585,089, 5,693,762 and 5,859, 205.

Thus, for example, PCT International Publication Number WO 92104381 teaches the production and use of humanized murine RSV antibodies in which at least a portion of the murine FR regions have been replaced by FR regions of human origin. Such antibodies, including fragments of intact antibodies with antigen-binding ability, are often referred to as "chimeric" antibodies.

Thus, as will be apparent to one of ordinary skill in the art, the present invention also provides for $F(ab')_2$, Fab, Fv and Fd fragments; chimeric antibodies in which the Fc and/or FR and/or CDR1 and/or CDR2 and/or light chain CDR3 regions have been replaced by homologous human or non-human sequences; chimeric $F(ab')_2$ fragment antibodies in which the FR and/or CDR1 and/or CDR2 and/or light chain CDR3 regions have been replaced by homologous human or non-human sequences; chimeric Fab fragment antibodies in which the FR and/or CDR1 and/or CDR2 and/or light chain CDR3 regions have been replaced by homologous human or non-human sequences; and chimeric Fd fragment antibodies in which the FR and/or CDR1 and/or CDR2 regions have been replaced by homologous human or non-human sequences. The present invention also includes so-called single chain antibodies.

Thus, the invention involves polypeptides of numerous size and type that bind specifically to cancer associated antigen polypeptides, and complexes of both cancer associated antigen polypeptides and their binding partners. These polypeptides may be derived also from sources other than antibody technology. For example, such polypeptide binding agents can be provided by degenerate peptide libraries which can be readily prepared in solution, in immobilized form or as phage display libraries. Combinatorial libraries also can be synthesized of peptides containing one or more amino acids. Libraries further can be synthesized of peptoids and non-peptide synthetic moieties.

Phage display can be particularly effective in identifying binding peptides useful according to the invention. Briefly, one prepares a phage library (using e.g. m13, fd, or lambda phage), displaying inserts from 4 to about 80 amino acid residues using conventional procedures. The inserts may represent, for example, a completely degenerate or biased array. One then can select phage-bearing inserts which bind to the cancer associated antigen polypeptide. This process can be repeated through several cycles of reselection of phage that bind to the cancer associated antigen polypeptide. Repeated rounds lead to enrichment of phage bearing particular sequences. DNA sequence analysis can be conducted to identify the sequences of the expressed polypeptides. The minimal linear portion of the sequence that binds to the cancer associated antigen polypeptide can be determined. One can repeat the procedure using a biased library containing inserts containing part or all of the minimal linear portion plus one or more additional degenerate residues upstream or downstream thereof. Yeast two-hybrid screening methods also may be used to identify polypeptides that bind to the cancer associated antigen polypeptides. Thus, the cancer associated antigen polypeptides of the invention, or a fragment thereof, can be used to screen peptide libraries, including phage display libraries, to identify and select peptide binding partners of the cancer associated antigen polypeptides of the invention. Such molecules can be used, as described, for screening assays, for purification protocols, for interfering directly with the functioning of cancer associated antigen and for other purposes that will be apparent to those of ordinary skill in the art.

As detailed herein, the foregoing antibodies and other binding molecules may be used for example to identify tissues expressing protein or to purify protein. Antibodies also may be coupled to specific diagnostic labeling agents for imaging of cells and tissues that express cancer associated antigens or to therapeutically useful agents according to standard coupling procedures. Diagnostic agents include, but are not limited to, barium sulfate, iocetamic acid, iopanoic acid, ipodate calcium, diatrizoate sodium, diatrizoate meglumine, metrizamide, tyropanoate sodium and radiodiagnostics including positron emitters such as fluorine-18 and carbon-11, gamma emitters such as iodine-123, technetium-99m, iodine-131 and indium-111, and nuclides for nuclear magnetic resonance such as fluorine and gadolinium. Other diagnostic agents useful in the invention will be apparent to one of ordinary skill in the art. As used herein, "therapeutically useful agents" include any therapeutic molecule which desirably is targeted selectively to a cell expressing one of the cancer antigens disclosed herein, including antineoplastic agents, radioiodinated compounds, toxins, other cytostatic or cytolytic drugs, and so forth. Antineoplastic therapeutics are well known and include: aminoglutethimide, azathioprine, bleomycin sulfate, busulfan, carmustine, chlorambucil, cisplatin, cyclophosphamide, cyclosporine, cytarabidine, dacarbazine, dactinomycin, daunorubicin, doxorubicin, taxol, etoposide, fluorouracil, interferon-α, lomustine, mercaptopurine, methotrexate, mitotane, procarbazine HCl, thioguanine, vinblastine sulfate and vincristine sulfate. Additional antineoplastic agents include those disclosed in Chapter 52, Antineoplastic Agents (Paul Calabresi and Bruce A. Chabner), and the introduction thereto, 1202–1263, of Goodman and Gilman's "The Pharmacological Basis of Therapeutics", Eighth Edition, 1990, McGraw-Hill, Inc. (Health Professions Division). Toxins can be proteins such as, for example, pokeweed anti-viral protein, cholera toxin, pertussis toxin, ricin, gelonin, abrin, diphtheria exotoxin, or *Pseudomonas* exotoxin. Toxin moieties can also be high energy-emitting radionuclides such as cobalt-60.

In the foregoing methods and compositions, antibodies prepared according to the invention also preferably are specific for the cancer associated antigen/MHC complexes described herein.

When "disorder" is used herein, it refers to any pathological condition where the cancer associated antigens are expressed. An example of such a disorder is cancer, including breast, gastric and prostate cancer as particular examples.

Samples of tissue and/or cells for use in the various methods described herein can be obtained through standard methods such as tissue biopsy, including punch biopsy and cell scraping, and collection of blood or other bodily fluids by aspiration or other methods.

In certain embodiments of the invention, an immunoreactive cell sample is removed from a subject. By "immunoreactive cell" is meant a cell which can mature into an immune cell (such as a B cell, a helper T cell, or a cytolytic T cell) upon appropriate stimulation. Thus immunoreactive cells include $CD34^+$ hematopoietic stem cells, immature T cells and immature B cells. When it is desired to produce cytolytic T cells which recognize a cancer associated antigen, the immunoreactive cell is contacted with a cell which expresses a cancer associated antigen under conditions favoring production, differentiation and/or selection of cytolytic T cells; the differentiation of the T cell precursor into a cytolytic T cell upon exposure to antigen is similar to clonal selection of the immune system.

Some therapeutic approaches based upon the disclosure are premised on a response by a subject's immune system, leading to lysis of antigen presenting cells, such as breast, gastric or prostate cancer cells which present one or more cancer associated antigens. One such approach is the administration of autologous CTLs specific to a cancer associated antigen/MHC complex to a subject with abnormal cells of the phenotype at issue. It is within the ability of one of ordinary skill in the art to develop such CTLs in vitro. An example of a method for T cell differentiation is presented in International Application number PCT/US96/05607. Generally, a sample of cells taken from a subject, such as blood cells, are contacted with a cell presenting the complex and capable of provoking CTLs to proliferate. The target cell can be a transfectant, such as a COS cell. These transfectants present the desired complex at their surface and, when combined with a CTL of interest, stimulate its proliferation. COS cells are widely available, as are other suitable host cells. Specific production of CTL clones is well known in the art. The clonally expanded autologous CTLs then are administered to the subject.

CTL proliferation can be increased by increasing the level of tryptophan in T cell cultures, by inhibiting enzymes which catabolize tryptophan, such as indoleamine 2,3-dioxygenase (IDO), or by adding tryptophan to the culture. Proliferation of T cells is enhanced by increasing the rate of proliferation and/or extending the number of divisions of the T cells in culture. In addition, increasing tryptophan in T cell cultures also enhances the lytic activity of the T cells grown in culture.

Another method for selecting antigen-specific CTL clones has recently been described (Altman et al., *Science* 274: 94–96, 1996; Dunbar et al., *Curr. Biol.* 8:413–416, 1998), in which fluorogenic tetramers of MHC class I molecule/peptide complexes are used to detect specific CTL clones. Briefly, soluble MHC class I molecules are folded in vitro in the presence of $\beta_2$-microglobulin and a peptide antigen which binds the class I molecule. After purification, the MHC/peptide complex is purified and labeled with biotin. Tetramers are formed by mixing the biotinylated peptide-MHC complex with labeled avidin (e.g. phycoerythrin) at a molar ratio or 4:1. Tetramers are then contacted with a source of CTLs such as peripheral blood or lymph node. The tetramers bind CTLs which recognize the peptide antigen/ MHC class I complex. Cells bound by the tetramers can be sorted by fluorescence activated cell sorting to isolate the reactive CTLs. The isolated CTLs then can be expanded in vitro for use as described herein.

To detail a therapeutic methodology, referred to as adoptive transfer (Greenberg, *J. Immunol.* 136(5): 1917, 1986; Riddel et al., *Science* 257: 238, 1992; Lynch et al, *Eur. J. Immunol.* 21: 1403–1410, 1991; Kast et al., *Cell* 59: 603–614, 1989), cells presenting the desired complex (e.g., dendritic cells) are combined with CTLs leading to proliferation of the CTLs specific thereto. The proliferated CTLs are then administered to a subject with a cellular abnormality which is characterized by certain of the abnormal cells presenting the particular complex. The CTLs then lyse the abnormal cells, thereby achieving the desired therapeutic goal.

The foregoing therapy assumes that at least some of the subject's abnormal cells present the relevant HLA/cancer associated antigen complex. This can be determined very easily, as the art is very familiar with methods for identifying cells which present a particular HLA molecule, as well as how to identify cells expressing DNA of the pertinent sequences, in this case a cancer associated antigen sequence. Once cells presenting the relevant complex are identified via the foregoing screening methodology, they can be combined with a sample from a patient, where the sample contains CTLs. If the complex presenting cells are lysed by the mixed CTL sample, then it can be assumed that a cancer associated antigen is being presented, and the subject is an appropriate candidate for the therapeutic approaches set forth supra.

Adoptive transfer is not the only form of therapy that is available in accordance with the invention. CTLs can also be provoked in vivo, using a number of approaches. One approach is the use of non-proliferative cells expressing the complex. The cells used in this approach may be those that normally express the complex, such as irradiated tumor cells or cells transfected with one or both of the genes necessary for presentation of the complex (i.e. the antigenic peptide and the presenting HLA molecule). Chen et al. (*Proc. Natl. Acad. Sci. USA* 88: 110–114, 1991) exemplifies this approach, showing the use of transfected cells expressing HPV-E7 peptides in a therapeutic regime. Various cell types may be used. Similarly, vectors carrying one or both of the genes of interest may be used. Viral or bacterial vectors are especially preferred. For example, nucleic acids which encode a cancer associated antigen polypeptide or peptide may be operably linked to promoter and enhancer sequences which direct expression of the cancer associated antigen polypeptide or peptide in certain tissues or cell types. The nucleic acid may be incorporated into an expression vector. Expression vectors may be unmodified extrachromosomal nucleic acids, plasmids or viral genomes constructed or modified to enable insertion of exogenous nucleic acids, such as those encoding cancer associated antigens, as described elsewhere herein. Nucleic acids encoding one or more cancer associated antigens also may be inserted into a retroviral genome, thereby facilitating integration of the nucleic acid into the genome of the target tissue or cell type. In these systems, the gene of interest is carried by a microorganism, e.g., a *Vaccinia* virus, pox virus, herpes simplex virus, retrovirus or adenovirus, and the materials de facto "infect" host cells. The cells which result present the complex of interest, and are recognized by autologous CTLs, which then proliferate.

A similar effect can be achieved by combining the cancer associated antigen or a stimulatory fragment thereof with an adjuvant to facilitate incorporation into antigen presenting cells in vivo. The cancer associated antigen polypeptide is processed to yield the peptide partner of the HLA molecule while a cancer associated antigen peptide may be presented without the need for further processing. Generally, subjects can receive an intradermal injection of an effective amount of the cancer associated antigen. Initial doses can be followed by booster doses, following immunization protocols standard in the art. Preferred cancer associated antigens include those found to react with allogeneic cancer antisera, shown in the examples below.

The invention involves the use of various materials disclosed herein to "immunize" subjects or as "vaccines". As used herein, "immunization" or "vaccination" means increasing or activating an immune response against an antigen. It does not require elimination or eradication of a condition but rather contemplates the clinically favorable enhancement of an immune response toward an antigen. Generally accepted animal models can be used for testing of immunization against cancer using a cancer associated antigen nucleic acid. For example, human cancer cells can be introduced into a mouse to create a tumor, and one or more cancer associated antigen nucleic acids can be delivered by the methods described herein. The effect on the cancer cells (e.g., reduction of tumor size) can be assessed as a measure of the effectiveness of the cancer associated antigen nucleic acid immunization. Of course, testing of the foregoing animal model using more conventional methods for immunization can include the administration of one or more cancer associated antigen polypeptides or peptides derived therefrom, optionally combined with one or more adjuvants and/or cytokines to boost the immune response. Methods for immunization, including formulation of a vaccine composition and selection of doses, route of administration and the schedule of administration (e.g. primary and one or more booster doses), are well known in the art. The tests also can be performed in humans, where the end point is to test for the presence of enhanced levels of circulating CTLs against cells bearing the antigen, to test for levels of circulating antibodies against the antigen, to test for the presence of cells expressing the antigen and so forth.

As part of the immunization compositions, one or more cancer associated antigens or stimulatory fragments thereof are administered with one or more adjuvants to induce an immune response or to increase an immune response. An adjuvant is a substance incorporated into or administered with antigen which potentiates the immune response. Adjuvants may enhance the immunological response by providing a reservoir of antigen (extracellularly or within macrophages), activating macrophages and stimulating specific sets of lymphocytes. Adjuvants of many kinds are well known in the art. Specific examples of adjuvants include monophosphoryl lipid A (MPL, SmithKline Beecham), a congener obtained after purification and acid hydrolysis of *Salmonella minnesota* Re 595 lipopolysaccharide; saponins including QS21 (SmithKline Beecham), a pure QA-21 saponin purified from *Quillja saponaria* extract; DQS21, described in PCT application WO96/33739 (SmithKline Beecham); QS-7, QS-17, QS-18, and QS-L1 (So et al., *Mol. Cells* 7:178–186, 1997); incomplete Freund's adjuvant; complete Freund's adjuvant; montanide; alum; CpG oligonucleotides (see e.g. Kreig et al., *Nature* 374:546–9, 1995); and various water-in-oil emulsions prepared from biodegradable oils such as squalene and/or tocopherol. Preferably, the peptides are administered mixed with a combination of DQS21/MPL. The ratio of DQS21 to MPL typically will be about 1:10 to 10:1, preferably about 1:5 to 5:1 and more preferably about 1:1. Typically for human administration, DQS21 and MPL will be present in a vaccine formulation in the range of about 1 μg to about 100 μg. Other adjuvants are known in the art and can be used in the invention (see, e.g. Goding, *Monoclonal Antibodies: Principles and Practice*, 2nd Ed., 1986). Methods for the preparation of mixtures or emulsions of peptide and adjuvant are well known to those of skill in the art of vaccination.

Other agents which stimulate the immune response of the subject can also be administered to the subject. For example, other cytokines are also useful in vaccination protocols as a result of their lymphocyte regulatory properties. Many other cytokines useful for such purposes will be known to one of ordinary skill in the art, including interleukin-12 (IL-12) which has been shown to enhance the protective effects of vaccines (see, e.g. *Science* 268: 1432–1434, 1995), GM-CSF and IL-18. Thus cytokines can be administered in conjunction with antigens and adjuvants to increase the immune response to the antigens.

There are a number of immune response potentiating compounds that can be used in vaccination protocols. These include costimulatory molecules provided in either protein or nucleic acid form. Such costimulatory molecules include the B7-1 and B7-2 (CD80 and CD86 respectively) molecules which are expressed on dendritic cells (DC) and interact with the CD28 molecule expressed on the T cell. This interaction provides costimulation (signal 2) to an antigen/MHC/TCR stimulated (signal 1) T cell, increasing T cell proliferation and effector function. B7 also interacts with CTLA4 (CD152) on T cells and studies involving CTLA4 and B7 ligands indicate that the B7-CTLA4 interaction can enhance antitumor immunity and CTL proliferation (Zheng P., et al. *Proc. Natl. Acad. Sci. USA* 95 (11): 6284–6289 (1998)).

B7 typically is not expressed on tumor cells so they are not efficient antigen presenting cells (APCs) for T cells. Induction of B7 expression would enable the tumor cells to stimulate more efficiently CTL proliferation and effector function. A combination of B7/IL-6/IL-12 costimulation has been shown to induce IFN-gamma and a Th1 cytokine profile in the T cell population leading to further enhanced T cell activity (Gajewski et al., *J. Immunol*, 154:5637–5648 (1995)). Tumor cell transfection with B7 has ben discussed in relation to in vitro CTL expansion for adoptive transfer immunotherapy by Wang et al., (*J. Immunol.*, 19:1–8 (1986)). Other delivery mechanisms for the B7 molecule would include nucleic acid (naked DNA) immunization (Kim J., et al. *Nat Biotechnol.*, 15:7:641–646 (1997)) and recombinant viruses such as adeno and pox (Wendtner et al., *Gene Ther.*, 4:7:726–735 (1997)). These systems are all amenable to the construction and use of expression cassettes for the coexpression of B7 with other molecules of choice such as the antigens or fragment(s) of antigens discussed herein (including polytopes) or cytokines. These delivery systems can be used for induction of the appropriate molecules in vitro and for in vivo vaccination situations. The use of anti-CD28 antibodies to directly stimulate T cells in vitro and in vivo could also be considered. Similarly, the inducible co-stimulatory molecule ICOS which induces T cell responses to foreign antigen could be modulated, for example, by use of anti-ICOS antibodies (Hutloff et al., *Nature* 397:263–266, 1999).

Lymphocyte function associated antigen-3 (LFA-3) is expressed on APCs and some tumor cells and interacts with CD2 expressed on T cells. This interaction induces T cell IL-2 and IFN-gamma production and can thus complement but not substitute, the B7/CD28 costimulatory interaction (Parra et al., *J. Immunol.*, 158:637–642 (1997), Fenton et al., *J. Immunother.*, 21:2:95–108 (1998)).

Lymphocyte function associated antigen-1 (LFA-1) is expressed on leukocytes and interacts with ICAM-1 expressed on APCs and some tumor cells. This interaction induces T cell IL-2 and IFN-gamma production and can thus complement but not substitute, the B7/CD28 costimulatory interaction (Fenton et al., *J. Immunother.*, 21:2:95–108 (1998)). LFA-1 is thus a further example of a costimulatory molecule that could be provided in a vaccination protocol in the various ways discussed above for B7.

Complete CTL activation and effector function requires Th cell help through the interaction between the Th cell CD40L (CD40 ligand) molecule and the CD40 molecule expressed by DCs (Ridge et al., *Nature*, 393:474 (1998), Bennett et al., *Nature*, 393:478 (1998), Schoenberger et al., *Nature*, 393:480 (1998)). This mechanism of this costimulatory signal is likely to involve upregulation of B7 and associated IL-6/IL-12 production by the DC (APC). The CD40-CD40L interaction thus complements the signal 1 (antigen/MHC-TCR) and signal 2 (B7-CD28) interactions.

The use of anti-CD40 antibodies to stimulate DC cells directly, would be expected to enhance a response to tumor antigens which are normally encountered outside of a inflammatory context or are presented by non-professional APCs (tumor cells). In these situations Th help and B7 costimulation signals are not provided. This mechanism might be used in the context of antigen pulsed DC based therapies or in situations where Th epitopes have not been defined within known cancer antigen precursors.

A cancer associated antigen polypeptide, or a fragment thereof, also can be used to isolate their native binding partners. Isolation of such binding partners may be performed according to well-known methods. For example, isolated cancer associated antigen polypeptides can be attached to a substrate (e.g., chromatographic media, such as polystyrene beads, or a filter), and then a solution suspected of containing the binding partner may be applied to the substrate. If a binding partner which can interact with cancer associated antigen polypeptides is present in the solution, then it will bind to the substrate-bound cancer associated antigen polypeptide. The binding partner then may be isolated.

It will also be recognized that the invention embraces the use of the cancer associated antigen cDNA sequences in expression vectors, as well as to transfect host cells and cell lines, be these prokaryotic (e.g., *E. coli*), or eukaryotic (e.g., dendritic cells, B cells, CHO cells, COS cells, yeast expression systems and recombinant baculovirus expression in insect cells). Especially useful are mammalian cells such as human, mouse, hamster, pig, goat, primate, etc. They may be of a wide variety of tissue types, and include primary cells and cell lines. Specific examples include keratinocytes, peripheral blood leukocytes, bone marrow stem cells and embryonic stem cells. The expression vectors require that the pertinent sequence, i.e., those nucleic acids described supra, be operably linked to a promoter.

The invention also contemplates delivery of nucleic acids, polypeptides or peptides for vaccination. Delivery of polypeptides and peptides can be accomplished according to standard vaccination protocols which are well known in the art. In another embodiment, the delivery of nucleic acid is accomplished by ex vivo methods, i.e. by removing a cell from a subject, genetically engineering the cell to include a cancer associated antigen, and reintroducing the engineered cell into the subject One example of such a procedure is outlined in U.S. Pat. No. 5,399,346 and in exhibits submitted in the file history of that patent, all of which are publicly available documents. In general, it involves introduction in vitro of a functional copy of a gene into a cell(s) of a subject, and returning the genetically engineered cell(s) to the subject. The functional copy of the gene is under operable control of regulatory elements which permit expression of the gene in the genetically engineered cell(s). Numerous transfection and transduction techniques as well as appropriate expression vectors are well known to those of ordinary skill in the art, some of which are described in PCT application WO95/00654. In vivo nucleic acid delivery using vectors such as viruses and targeted liposomes also is contemplated according to the invention.

In preferred embodiments, a virus vector for delivering a nucleic acid encoding a cancer associated antigen is selected from the group consisting of adenoviruses, adeno-associated viruses, poxviruses including vaccinia viruses and attenuated poxviruses, Semliki Forest virus, Venezuelan equine encephalitis virus, retroviruses, Sindbis virus, and Ty virus-like particle. Examples of viruses and virus-like particles which have been used to deliver exogenous nucleic acids include: replication-defective adenoviruses (e.g., Xiang et al., *Virology* 219:220–227, 1996; Eloit et al., *J. Virol.* 7:5375–5381, 1997; Chengalvala et al., *Vaccine* 15:335–339, 1997), a modified retrovirus (Townsend et al., *J. Virol.* 71:3365–3374, 1997), a nonreplicating retrovirus (Irwin et al., *J. Virol.* 68:5036–5044, 1994), a replication defective Semliki Forest virus (Zhao et al., *Proc. Natl. Acad. Sci. USA* 92:3009–3013, 1995), canarypox virus and highly attenuated vaccinia virus derivative (Paoletti, *Proc. Natl. Acad. Sci. USA* 93:11349–11353, 1996), non-replicative vaccinia virus (Moss, *Proc. Natl. Acad. Sci. USA* 93:11341–11348, 1996), replicative vaccinia virus (Moss, *Dev. Biol. Stand.* 82:55–63, 1994), Venezuelan equine encephalitis virus (Davis et al., *J. Virol.* 70:3781–3787, 1996), Sindbis virus (Pugachev et al., *Virology* 212:587–594, 1995), and Ty virus-like particle (Allsopp et al., *Eur. J. Immunol* 26:1951–1959, 1996). In preferred embodiments, the virus vector is an adenovirus.

Another preferred virus for certain applications is the adeno-associated virus, a double-stranded DNA virus. The adeno-associated virus is capable of infecting a wide range of cell types and species and can be engineered to be replication-deficient. It further has advantages, such as heat and lipid solvent stability, high transduction frequencies in cells of diverse lineages, including hematopoietic cells, and lack of superinfection inhibition thus allowing multiple series of transductions. The adeno-associated virus can integrate into human cellular DNA in a site-specific manner, thereby minimizing the possibility of insertional mutagenesis and variability of inserted gene expression. In addition, wild-type adeno-associated virus infections have been followed in tissue culture for greater than 100 passages in the absence of selective pressure, implying that the adeno-associated virus genomic integration is a relatively stable event. The adeno-associated virus can also function in an extrachromosomal fashion.

In general, other preferred viral vectors are based on non-cytopathic eukaryotic viruses in which non-essential genes have been replaced with the gene of interest. Non-cytopathic viruses include retroviruses, the life cycle of which involves reverse transcription of genomic viral RNA into DNA with subsequent proviral integration into host cellular DNA. Adenoviruses and retroviruses have been approved for human gene therapy trials. In general, the retroviruses are replication-deficient (i.e., capable of directing synthesis of the desired proteins, but incapable of manufacturing an infectious particle). Such genetically altered retroviral expression vectors have general utility for the high-efficiency transduction of genes in vivo. Standard protocols for producing replication-deficient retroviruses (including the steps of incorporation of exogenous genetic material into a plasmid, transfection of a packaging cell lined with plasmid, production of recombinant retroviruses by the packaging cell line, collection of viral particles from tissue culture media, and infection of the target cells with viral particles) are provided in Kriegler, M., "Gene Transfer and Expression, A Laboratory Manual," W.H. Freeman Co., New York (1990) and Murry, E. J. Ed. "Methods in Molecular Biology," vol. 7, Humana Press, Inc., Clifton, N.J. (1991).

Preferably the foregoing nucleic acid delivery vectors: (1) contain exogenous genetic material that can be transcribed and translated in a mammalian cell and that can induce an immune response in a host, and (2) contain on a surface a ligand that selectively binds to a receptor on the surface of a target cell, such as a mammalian cell, and thereby gains entry to the target cell.

Various techniques may be employed for introducing nucleic acids of the invention into cells, depending on whether the nucleic acids are introduced in vitro or in vivo in a host. Such techniques include transfection of nucleic acid-$CaPO_4$ precipitates, transfection of nucleic acids associated with DEAE, transfection or infection with the foregoing viruses including the nucleic acid of interest, liposome mediated transfection, and the like. For certain uses, it is preferred to target the nucleic acid to particular cells. In such instances, a vehicle used for delivering a nucleic acid of the invention into a cell (e.g., a retrovirus, or other virus; a liposome) can have a targeting molecule attached thereto. For example, a molecule such as an antibody specific for a surface membrane protein on the target cell or a ligand for a receptor on the target cell can be bound to or incorporated within the nucleic acid delivery vehicle. Preferred antibodies include antibodies which selectively bind a cancer associated antigen, alone or as a complex with a MHC molecule. Especially preferred are monoclonal antibodies. Where liposomes are employed to deliver the nucleic acids of the invention, proteins which bind to a surface membrane protein associated with endocytosis may be incorporated into the liposome formulation for targeting and/or to facilitate uptake. Such proteins include capsid proteins or fragments thereof tropic for a particular cell type, antibodies for proteins which undergo internalization in cycling, proteins that target intracellular localization and enhance intracellular half life, and the like. Polymeric delivery systems also have been used successfully to deliver nucleic acids into cells, as is known by those skilled in the art. Such systems even permit oral delivery of nucleic acids.

The therapeutics of the invention can be administered by any conventional route, including injection or by gradual infusion over time. The administration may, for example, be oral, intravenous, intraperitoneal, intramuscular, intracavity, subcutaneous, or transdermal. When cancer associated antigen peptides are used for vaccination, modes of administration which effectively deliver the cancer associated antigen and adjuvant, such that an immune response to the antigen is increased, can be used. For administration of a cancer associated antigen peptide in adjuvant, preferred methods include intradermal, intravenous, intramuscular and subcutaneous administration. Although these are preferred embodiments, the invention is not limited by the particular modes of administration disclosed herein. Standard references in the art (e.g., *Remington's Pharmaceutical Sciences,*

18th edition, 1990) provide modes of administration and formulations for delivery of immunogens with adjuvant or in a non-adjuvant carrier. When antibodies are used therapeutically, a preferred route of administration is by pulmonary aerosol. Techniques for preparing aerosol delivery systems containing antibodies are well known to those of skill in the art. Generally, such systems should utilize components which will not significantly impair the biological properties of the antibodies, such as the paratope binding capacity (see, for example, Sciarra and Cutie, "Aerosols," in *Remington's Pharmaceutical Sciences*, 18th edition, 1990, pp 1694–1712; incorporated by reference). Those of skill in the art can readily determine the various parameters and conditions for producing antibody aerosols without resort to undue experimentation. When using antisense preparations of the invention, slow intravenous administration is preferred.

The compositions of the invention are administered in effective amounts. An "effective amount" is that amount of a cancer associated antigen composition that alone, or together with further doses, produces the desired response, e.g. increases an immune response to the cancer associated antigen. In the case of treating a particular disease or condition characterized by expression of one or more cancer associated antigens, such as breast, gastric or prostate cancers, the desired response is inhibiting the progression of the disease. This may involve only slowing the progression of the disease temporarily, although more preferably, it involves halting the progression of the disease permanently. This can be monitored by routine methods or can be monitored according to diagnostic methods of the invention discussed herein. The desired response to treatment of the disease or condition also can be delaying the onset or even preventing the onset of the disease or condition.

Such amounts will depend, of course, on the particular condition being treated, the severity of the condition, the individual patient parameters including age, physical condition, size and weight, the duration of the treatment, the nature of concurrent therapy (if any), the specific route of administration and like factors within the knowledge and expertise of the health practitioner. These factors are well known to those of ordinary skill in the art and can be addressed with no more than routine experimentation. It is generally preferred that a maximum dose of the individual components or combinations thereof be used, that is, the highest safe dose according to sound medical judgment. It will be understood by those of ordinary skill in the art, however, that a patient may insist upon a lower dose or tolerable dose for medical reasons, psychological reasons or for virtually any other reasons.

The pharmaceutical compositions used in the foregoing methods preferably are sterile and contain an effective amount of cancer associated antigen or nucleic acid encoding cancer associated antigen for producing the desired response in a unit of weight or volume suitable for administration to a patient. The response can, for example, be measured by determining the immune response following administration of the cancer associated antigen composition via a reporter system by measuring downstream effects such as gene expression, or by measuring the physiological effects of the cancer associated antigen composition, such as regression of a tumor or decrease of disease symptoms. Other assays will be known to one of ordinary skill in the art and can be employed for measuring the level of the response.

The doses of cancer associated antigen compositions (e.g., polypeptide, peptide, antibody, cell or nucleic acid) administered to a subject can be chosen in accordance with different parameters, in particular in accordance with the mode of administration used and the state of the subject. Other factors include the desired period of treatment. In the event that a response in a subject is insufficient at the initial doses applied, higher doses (or effectively higher doses by a different, more localized delivery route) may be employed to the extent that patient tolerance permits.

In general, for treatments for eliciting or increasing an immune response, doses of cancer associated antigen are formulated and administered in doses between 1 ng and 1 mg, and preferably between 10 ng and 100 µg, according to any standard procedure in the art. Where nucleic acids encoding cancer associated antigen of variants thereof are employed, doses of between 1 ng and 0.1 mg generally will be formulated and administered according to standard procedures. Other protocols for the administration of cancer associated antigen compositions will be known to one of ordinary skill in the art, in which the dose amount, schedule of injections, sites of injections, mode of administration (e.g., intra-tumoral) and the like vary from the foregoing. Administration of cancer associated antigen compositions to mammals other than humans, e.g. for testing purposes or veterinary therapeutic purposes, is carried out under substantially the same conditions as described above.

When administered, the pharmaceutical compositions of the invention are applied in pharmaceutically-acceptable amounts and in pharmaceutically-acceptable preparations. The term "pharmaceutically acceptable" means a non-toxic material that does not interfere with the effectiveness of the biological activity of the active ingredients. Such preparations may routinely contain salts, buffering agents, preservatives, compatible carriers, and optionally other therapeutic agents. When used in medicine, the salts should be pharmaceutically acceptable, but non-pharmaceutically acceptable salts may conveniently be used to prepare pharmaceutically-acceptable salts thereof and are not excluded from the scope of the invention. Such pharmacologically and pharmaceutically-acceptable salts include, but are not limited to, those prepared from the following acids: hydrochloric, hydrobromic, sulfuric, nitric, phosphoric, maleic, acetic, salicylic, citric, formic, malonic, succinic, and the like. Also, pharmaceutically-acceptable salts can be prepared as alkaline metal or alkaline earth salts, such as sodium, potassium or calcium salts.

A cancer associated antigen composition may be combined, if desired, with a pharmaceutically-acceptable carrier. The term "pharmaceutically-acceptable carrier" as used herein means one or more compatible solid or liquid fillers, diluents or encapsulating substances which are suitable for administration into a human. The term "carrier" denotes an organic or inorganic ingredient, natural or synthetic, with which the active ingredient is combined to facilitate the application. The components of the pharmaceutical compositions also are capable of being co-mingled with the molecules of the present invention, and with each other, in a manner such that there is no interaction which would substantially impair the desired pharmaceutical efficacy.

The pharmaceutical compositions may contain suitable buffering agents, including: acetic acid in a salt; citric acid in a salt; boric acid in a salt; and phosphoric acid in a salt.

The pharmaceutical compositions also may contain, optionally, suitable preservatives, such as: benzalkonium chloride; chlorobutanol; parabens and thimerosal.

The pharmaceutical compositions may conveniently be presented in unit dosage form and may be prepared by any of the methods well-known in the art of pharmacy. All methods include the step of bringing the active agent into association with a carrier which constitutes one or more accessory ingredients. In general, the compositions are prepared by uniformly and intimately bringing the active compound into association with a liquid carrier, a finely divided solid carrier, or both, and then, if necessary, shaping the product.

Compositions suitable for oral administration may be presented as discrete units, such as capsules, tablets, lozenges, each containing a predetermined amount of the active compound. Other compositions include suspensions in aqueous liquids or non-aqueous liquids such as a syrup, elixir or an emulsion.

Compositions suitable for parenteral administration conveniently comprise a sterile aqueous or non-aqueous preparation of cancer associated antigen polypeptides or nucleic acids, which is preferably isotonic with the blood of the recipient. This preparation may be formulated according to known methods using suitable dispersing or wetting agents and suspending agents. The sterile injectable preparation also may be a sterile injectable solution or suspension in a non-toxic parenterally-acceptable diluent or solvent, for example, as a solution in 1,3-butane diol. Among the acceptable vehicles and solvents that may be employed are water, Ringer's solution, and isotonic sodium chloride solution. In addition, sterile, fixed oils are conventionally employed as a solvent or suspending medium. For this purpose any bland fixed oil may be employed including synthetic mono- or di-glycerides. In addition, fatty acids such as oleic acid may be used in the preparation of injectables. Carrier formulation suitable for oral, subcutaneous, intravenous, intramuscular, etc. administrations can be found in *Remington's Pharmaceutical Sciences*, Mack Publishing Co., Easton, Pa.

EXAMPLES

Example 1

SEREX Screening of Breast, Gastric and Prostate Cancer Cells

Breast, gastric and prostate cancer cDNA libraries were established, using standard techniques, and the libraries were screened, using the SEREX methodology described by Sahin et al., *Proc. Natl. Acad. Sci. USA* 92: 11810 (1995), and by Chen et al., *Proc. Natl. Acad. Sci. USA* 94: 1914 (1997), each of which is incorporated by reference in its entirety.

To be specific, total RNA was isolated by homogenizing tumor samples in 4M guanidinium thiocyanate/0.5% sodium N-lauryl sarcosine/25 mM EDTA followed by centrifugation in 5.7 M CsCl/25 mM sodium acetate/10 µM EDTA at 32,000 rpm. Total mRNA was removed by passing the sample over an oligo-dT cellulose column. The cDNA libraries were then constructed by taking 5 µg of mRNA, using standard methodologies to reverse transcribe the material. Breast cancer libraries were prepared from two different breast cancer patients, referred to as "MT" and "MK". Gastric cancer libraries were prepared from a gastric cancer patient, referred to as "YS".

The cDNA was used to construct a lambda phage library, and 500 phages were plated onto XL1-Blue MRF *E. coli*, and incubated for eight hours at 37° C. A nitrocellulose membrane was then placed on the plate, followed by overnight incubation. The membrane was then washed, four times, with Tris buffered saline (TBS) which contained 0.05% Tween, and was then immersed in TBS containing 5% non-fat dried milk. After one hour, the membrane was incubated with conjugates of peroxidase-goat anti human IgG specific for Fc portions of human antibodies (1:2000, diluted in TBS with 1% BSA). The incubation was carried out for one hour, at room temperature, and the membrane was then washed three times with TBS. Those clones which produced antibodies were visualized with 0.06% 3,3'diaminobenzidine tetrachloride and 0.015% $H_2O_2$, in 50 mM Tris (pH 7.5). Any clones which produced immunoglobulin were marked, and then the membrane was washed, two further times, with TBS that contained 0.05% Tween, and then twice with "neat" TBS.

The membranes were then incubated in 1:100 diluted patient serum, overnight, at 4° C. The patient serum had been pretreated. Specifically, 5 ml samples were diluted to 10 ml with TBS containing 1% bovine serum albumin, and 0.02% $Na_3N$. The serum had been treated to remove antibodies to bacteriophage, by passing it through a 5 ml Sepharose column, to which a lysate of *E. coli* Y1090 had been attached, followed by passage over a second column which had *E. coli* lysate and lysate of *E. coli* infected with lambda bacteriophage. The screening was carried out five times. The samples were then diluted to 50 ml, and kept at −80° C., until used as described herein.

Following the overnight incubation with the membrane, the membrane was washed twice with TBS/0.05% Tween 20, and then once with TBS. A further incubation was carried out, using the protocols discussed supra, for the peroxidase labeled antibodies.

The positive clones were then sequenced, using standard techniques. Following comparison of the sequences to information available in data banks, clones were resolved into known and unknown genes. Some clones corresponded to previously identified human proteins and nucleotide sequences, and other clones have not been identified in humans previously, although there were related molecules found in other species. Still other clones represent molecules for which no related sequences were found (most clones contained very short sections (e.g. 25 or fewer nucleotides) that corresponded to portions of unrelated to sequences). Some GenBank accession numbers representative of sequences having homology to the cancer associated antigen nucleotide sequences of the invention are presented in Table 1. All of the homologous sequences are accessible in publicly-available databases by reference to the sequences' accession numbers provided in Table 1.

Breast Cancer Clones

The nucleotide sequences of clones derived from breast cancer patients "MT" and "MK" are presented as SEQ ID NOs:1–205. Polypeptides encoded by open reading frames of the nucleic acid clones are presented as SEQ ID Nos: 594–829; the correspondence between nucleic acid molecules and encoded polypeptides is shown in Table 2.

Gastric Cancer Clones

The nucleotide sequences of clones derived from gastric cancer patient "YS" are presented as SEQ ID NOs:206–352 (clones beginning with "YS"). Polypeptides encoded by open reading frames of the YS nucleic acid clones are presented as SEQ ID NOs:830–1083; the correspondence between nucleic acid molecules and encoded polypeptides is shown in Table 2.

Prostate Cancer Clones

The nucleotide sequences of clones derived from prostate cancer patient "ZH" are presented as SEQ ID NOs:353–593 (clones beginning with "ZH"). Polypeptides encoded by open reading frames of the ZH nucleic acid clones are presented as SEQ ID Nos:1084–1332; the correspondence between nucleic acid molecules and encoded polypeptides is shown in Table 2.

TABLE 1

Sequence homologies (GenBank Accession Numbers)

SEQ ID NO. 1
NGO-Br-38 combined

NM_006644.1, AF039695.1, AB003334.1, AB003333.1, D86956.1, D67017.1, D67016.1, Z47807.1, NM_013559.1, L40406.1, AB005282.1, AB005281.1, AB005280.1, AB023420.1, X67643.1, NM_008300.1, D85904.1, AC011661.5, AE003611.1, AL109620.4, AC007049.8, AC005992.15, AC007066.4, AC006080.1, AC009155.3, AF222716.1, AC009223.2, A0004251.1, AC002367.1, AL161553.2, AL161539.2, AL117202.1, AL009183.10, Z97336.1, AB006696.1, AI658961.1, AW571648.1, AW474070.1, AA843693.1, AW608075.1, AW470142.1, AW572452.1, AA543054.1, AW385582.1, AI742981.1, AW612980.1, AW612983.1, AI582881.1, AI751853.1, AI378269.1, AI920808.1, M654.608.1, AI819251.1, AI831339.1, AI753470.1, AI312753.1, AI803588.1, AI563996.1, AA232636.1, AW015796.1, AW117974.1, AI668853.1, AA535277.1, AA993280.1, AA632202.1, AA912023.1, AW627645.1, AW027050.1, AI337175.1, AI123280.1, AA761750.1, AW316651.1, AI223412.1, AW771160.1, AA219263.1, AW068948.1, AA482770.1, AA166716.1, AW236067.1, AA166806.1, AA485151.1, AI369932.1, AI250881.1, AA933881.1, AI262020.1, AI751852.1, AI050716.1, H52653.1, AI651186.1, AA678506.1, AA582157.1, AW628153.1, AI493255.1, AW340810.1, AI223825.1, AW837156.1, AA136424.1, AA953645.1, AI582484.1, AI673134.1, AW820299.1, AA394027.1, T58153.1, T36072.1, AW390368.1, F22410.1, AA417317.1, AW020035.1, AA278231.1, AI361237.1, AI288972.1, AA810686.1, AW103624.1, AW604836.1, AA730742.1, AA082043.1, Z20100.1, D58216.1, AI799265.1, D29622.1, AA435594.1, AA233888.1, AA485036.1, AI612928.1, AI630481.1, F07487.1, AA731716.1, AA417255.1, AA804371.1, AA571359.1, AA465183.1, F08794.1, T34783.1, Z41841.1, F03714.1, AL137142.8, AC012569.3, AP001563.1, AC022671.2, AC020999.4, AC011743.3, AP000635.1, AP000610.2, AC008070.3, AC022797.3, AC005506.6, AL096782.3,
SEQ ID NO. 2
NGO-Br-39
MK262/T3 5'

AF039695.1, AB003334.1, D86956.1, NM_006644.1, AB003333.1, NM_013559.1, D67016.1, L40406.1, Z47807.1, D67017.1, AB005277.1, AB005278.1, NM_011020.1, U23921.1, D49482.1, AB001926.1, NM_014278.1, AB023421.1, LI2723.1, AB005279.1, X67643.1, AB005280.1, AF077354.1, NM_008300.1, AB023420.1, D85904.1, AB005281.1, AC024830.1, L08605.1, AC011294.3, AC009424.2, AC022520.2, NM_0133931 AC019018.7, AF093415.1, AF161311.1, AF136711.1, AE001434.1, AE001433.1, Z49769.1, AC024813.1, AE003645.1, AC011609.9, AC004150.8, AC004801.1, AL163244.2, AP001699.1, AP001605.1, L16771.1, AW820299.1, AW859988.1, AW859943.1, AW604836.1, AW820234.1, AW206874.1, AJ094015.1, AA885873.1, AW820232.1, AI702970.1, AW390368.1, AA777564.1, AA580595.1, H91160.1, AA777031.1, AW608075.1, H54657.1, H64019.1, AI658961.1, H63551.1, AA811573.1, AW628153.1, AA749004.1, AI800379.1, W45471.1, AI751852.1, AW385582.1, AI290252.1, AW389335.1, AA953645.1, AW238563.1, AA805016.1, F08794.1, F07487.1, AW631423.1, T63090.1, N84915.1, AW630933.1, AW474070.1, AA166806.1, N84914.1, AI758907.1, AW103624.1, AW571648.1, AA394027.1, AI002886.1, AA094644.1, AW391561.1, AW362751.1, I163595.1, AW609781.1, I154656.1, AW572452.1 W86085.1, AW577563.1, AW820231.1, AW362766.1, AA555929.1, AA555921.1, AA485036.1, AW820224.1, AW395172.1, H91211.1, AW316651.1, AI838486.1, AA571359.1, AJ397361.1, AA334479.1, AW754210.1, AW583074.1, AI760838.1, AW578928.1, AA212025.1, CS1194.1, AA645750.1, AW819755.1, AW125594.1, AU080443.1, AA919208.1, AA755774.1, AA615363.1, AA445826.1, AA117945.1, AI337175.1, AW819997.1, AW470142.1, AA626524.1, AA079853.1, W22433.1, T29047.1, AI626242.1, AW839103.1, AU035998.1, AA624532.1, AA572403.1, AA431598.1, AA370218.1, AA571473.1, AW754207.1, AW366794.1, AL137142.8, A0015501.3, AC021286.3, AC006882.2, AC068895.1, AC055115.2, AC013660.4, AL354918.3, AL138763.2, AC0I0646.4, AC010267.5, AC008642.3, AC008484.3, AC006279.6, AC006278.6, AC016522.4, AC019327.4, AC021435.2, AC011301.4, AP216669.1, AL159973.2, AL034557.7,
SEQ ID NO. 3
NGO-Br-39
MK494/T3 5'

AF039695.1, AB003334.1, D86956.1, Z47807.1, NM_006644.1, AB003333.1, NM_013559.1, D67016.1, L40406.1, D67017.1, AB005277.1, AB005278.1, AB005276.1, NM_011020.1, U23921.1, D49482.1, AB001926.1, NM_014278.1, AB023421.1, LI2723.1, AB005279.1, X67643.1, AF077354.1, NM_008300.1, AB005275.1, AB023420.1, D85904.1, AC009424.2, NM_013393.1, AF093415.1, AC010852.5, AF161311.1, AF136711.1, AC005516.1, AE00I434.1, AE001433.1, AC003099.1, Z49769.1, AP001521.1, AC007678.3, AC006403.3, AC024813.1, AE003684.1, AC004668.1, AC004879.1, AC006354.2, AC010183.6, AC005049.2, AC004150.8, AC0O4501.1, AF049895.1, AF068862.1, AF004739.1, AL162911.1, Z68341.1, AL032629.1, AL023578.1, U41009.1, L16771.1, AI094015.1, AW206874.1, AA777564.1, AA885873.1, AI702970.1, AI800379.1, AA580595.1, AA805016.1, AW631423.1, AA811573.1, AW630933.1, H91160.1, AI290252.1, H54657.1, H64019.1, AI002886.1, N84915.1, W45471.1, H63551.1, H63595.1, AW238563.1, H54656.1, AW577563.1, N84914.1, AA094644.1, AA749004.1, H91211.1, AI758907.1, AA777031.1, AA334479.1, AW604836.1, AW820299.1, AA580712.1, AW859988.1, AW859943.1, AW820232.1, AW820234.1, AL042714.2, AW390368.1, AW391561.1, H64073.1, AW362751.1, W86141.1, W86085.1, AA105012.1, AW608075.1, AW389335.1, AW820231.1, AW362766.1, AA555929.1, AA555921.1, AI658961.1, AW820224.1, AW391572.1, AA714219.1, AA108277.1, AA580845.1, AJ397361.1, AW210124.1, AW754210.1, AW583074.1, AI760838.1, AW578928.1, AA212025.1, AI656127.1, AW385582.1, AA645750.1, AW819755.1, AW125594.1, AU080443.1, AA919208.1, AA755774.1, AA615363.1, AA445826.1, AA117945.1, AI633338.1, AI203278.1, AW819997.1, AW628153.1, AA626524.1, W22433.1, AI751852.1, AA953645.1, F08794.1, F07487.1, T63090.1, I29047.1, C81194.1, AW839103.1, AU035998.1, AA370218.1, AW754207.1, AI314009.1, AW366794.1, AV162858.1, AI792084.1, AA909261.1, AL137142.8, AC015501.3, AC021286.3, AC069062.1, AC024112.9, AC008876.3, AL138763.2, AC010646.4, AC006278.6, AC016522.4, AC023956.2, AC005282.1, AP001863.1, AL034557.7, AC023855.3, AC026995.2, AC018688.4, AC022758.3, AC013294.3, AC006876.1, AL117373.6, AL117335.19, AL157821.1,

TABLE 1-continued

Sequence homologies (GenBank Accession Numbers)

SEQ ID NO. 4
NGO-Br-55
MK225/T3 5'

NM_005716.1, AF089816.1, AF032120.1, AF089818.1, AF089517.1, AY104355.1, AF061263.1, AI05031812
AC007678.3, AC012099.4, NM_004364.1, AC006019.2, AC007397.21, AC007535.3, U51244.1, U34070.1, U94788.1,
U92845.1, Z69303.1, Z95127.1, Z31375.1, X54156.1, X87248.1, Y11525.1, AP000559.1, M93344.1, AW732338.1,
AW409923.1, T25830.1, W06974.1, AW258706.1, AA396587.1, AA300306.1, AA839164.1, AF143339.1, AW416823.1,
AI645842.1, AA702414.1, AA259652.1, AA158704.1, AW316813.1, AW293608.1, AI989542.1, AI971171.1, AI903437.1,
AI903333.1, AI903269.1, AI903268.1, AI510739.1, AI696771.1, AI669881.1, AU056473.1, AI508747.1, AI462731.1,
AI424712.1, AI418022.1, AI369600.1, AI335709.1, AI193578.1, AA974969.1, AA565967.1, AA513461.1, AA468577.1,
AA396061.1, AA367767.1, W87364.1, N39553.1, H49150.1, H25130.1, R10174.1, T52003.1, AW795860.1, AW594540.1,
AW514789.1, AW472932.1, AW359396.1, AW293828.1, AW149413.1, AW064723.1, AW016496.1, AW008028.1,
AI955331.1, AI697357.1, AI660572.1, AI565813.1, AI540768.1, AI538719.1, AI360009.1, AI126655.1, AI033638.1,
AA515831.1, AA503485.1, AA496487.1, AA428815.1, AA280408.1, AA036554.1, N67732.1, N25184.1, H03122.1,
T35597.1, T16741.1, AC008569.5, AC022478.3, AL355872.2, AL162371.5, AL137781.3, AC010442.4, AC031984.2,
AC060234.2, AC015958.3, AP000898.2, AP000919.2, AL121920.11, AL353195.1,
SEQ ID NO. 5
NGO-Br-55
MK225/T7 3'

AF028824.1, NM_005716.1, AF089816.1, AE001104.1, AL096829.17, AJ007636.1, I28482.1, AC012467.9, AC007252.2,
AC005757.1, AL049759.10, AB033031.1, AL033502.1, AF155065.1, AL138995.3, Z82214.23, AL031680.17,
AJ222796.1, AW409924.1, AI720167.1, AI660895.1, AI755163.1, AI472081.1, AA781474.1, AI073909.1, W73036.1,
AI697434.1, AI887371.1, AI032395.1, AA581812.1, AA149940.1, AA535595.1, M085734.1, AI951003.1, AA666165.1,
AI869948.1, AA579893.1, AI624402.1, R32110.1, AI241188.1, N64621.1, AA740666.1, AI589363.1, AW079516.1,
AA677956.1, AW166984.1, AI343472.1, AI831080.1, AW613269.1, AA878576.1, AI634734.1, AI955436.1, AI423229.1,
AI683679.1, R50716.1, AA705739.1, AI690685.1, AW050771.1,1164249.1, AI867388.1, AW131086.1, AI654473.1,
AI272198.1, AA325291.1, M672928.1, AW193998.1, R40181.1, AI886660.1, AA612759.1, AI867293.1, AI499113.1,
AA404606.1, AI270050.1, AI056166.1, AA995431.1, AW664356.1, AI695629.1, AI289585.1, AI218312.1, T54484.1,
AA918644.1, AI709119.1, R33590.1, AI889242.1, R32109.1, AI804816.1, T30333.1, R09164.1, R77191.1, AA404222.1,
AA304135.1, AW664565.1, AW664371.1, R33694.1, AA160211.1, AW439960.1, AA320369.1, AA135772.1,
AA135729.1, AI392813.1, AW190218.1, AI370449.1, W73301.1, AI298917.1, AA160212.1, AA434159.1, T16203.1,
AW752314.1, R1769156.1, AW338853.1, N78888.1, AA295659.1, T48755.1, AI933841.1, AA887316.1, AW470194.1,
N55776.1, AW007413.1, AC008569.5, AC010765.2, AL157781.1, AC007819.7, AL355350.2, AL16164.6,5, AL162454.2,
AC051621.1, AC026055.3, AC013570.3, AC020565.4, AC023193.3, AC011286.4, AP000846.1, AC053465.3,
AC024715.3, AC023914.1, AC010729.3, AC010147.4, AL139253.1, AL031301.1,
SEQ ID NO. 6
NGO-Br-61
MK751/T3 5'

AK001824.1, AK001625.1, AB020657.1, AK000931.1, AL137640.1, NM_016389.1, AF161553.1, AK001273.1,
NM_006469.1, AJ012449.1, AL031674.1, AC006928.15, AC006581.16, AC007436.1, AL049861.18, AC009303.2,
AE003772.1, AC004843.1, AF003141.1, U88180.1, AL034350.2, AP000606.1, AC006068.3, AC006031.2, AC006996.2,
AC013417.4, AC005319.1, AC003050.1, AJ009736.1, AC002065.1, Z69383.1, L14324.1, AP000I55.1, AP000283.1,
AP000109.1, AI887429.1, Z42725.1, AA486796.1, AI697765.1, AI300924.1, W31762.1, AA516054.1, H47565.1,
AI625041.1, AI498683.1, AA962704.1, AA581961.1, Z28830.1, AI621215.1, AI560075.1, AA603342.1, AA211203.1,
P1453000.1, AA505767.1, H29506.1, M493165.1, AW338106.1, AW271945.1, AI561182.1, AI357213.1, AA888065.1,
AI950251.1, AA182641.1, AI750267.1, AW536810.1, AI893732.1, AA881079.1, AA833428.1, AA759435.1, AA274870.1,
AA260237.1, AI564193.1, AA172740.1, AA837350.1, AA572435.1, AA290546.1, AA563475.1, AA622090.1,
AW681468.1, AW261744.1, AA638984.1, AW107357.1, AW261646.1, AA170526.1, AA848235.1, AI873826.1,
AI157598.1, AI750915.1, AI596266.1, AI929865.1, AI790736.1, AI649320.1, AI043196.1, AL023060.1, AW630831.1,
AI314622.1, AI314243.1, AI098095.1, AI043182.1, AA511211.1, AA434721.1, AA140498.1, AA098508.1, R74754.1,
AW532477.1, AI408553.1, AW750607.1, AV218438.1, AI048358.1, AA458054.1, AI763491.1, AV311575.1,
AV005809.1, AA091451.1, DS8165.1, AI911938.1, AI548180.1, AA086929.1, AI581089.1, AW822437.1, AW208414.1,
AW145984.1, AV159067.1, AI607800.1, AW535768.1, AW822436.1, AI182297.1, AA313132.1, AA799539.1,
AI971805.1, AV209231.1, AV207950.1, AV154324.1, AV118302.1, AV175071.1, AC016552.5, AC008499.4,
AP001803.1, AP000479.2, AC027649.4, AC012429.4, AL353692.3, AC069214.1, AC024096.7, AC008670.3,
AC067813.1, AC021601.3, AC023659.2, AC023818.2, AC009009.2, Z97201.7, AP001815.1,
SEQ ID NO. 7
NGO-Br-61
MK75/T7 3'

AK001824.1, AK001625.1, AB020657.1, AK000931.1, AL137640.1, NM_016389.1, AF161553.1, AK001273.1,
NM_006469.1, AJ012449.1; AL031674.1, AC006928.15, AC006581.16, AC007436.1, AL049861.18, AC009303.2,
AE003772.1, A0004843.1, AF003141.1, U88180.1, AL034350.2, AP000606.1, AC006068.3, AC006031.2, AC006996.2,
AC013417.4, AC005319.1, AC003050.1, AJ009736.1, AC002065.1, Z69383.1, L14324.1, AP000185.1, AP000283.1,
AP000109.1, AI887429.1, Z42725.1, AA486796.1, AI697765.1, M300924.1, W31762.1, AA516054.1, H47565.1,
AI625041.1, AI498683.1, AA962704.1, AA581961.1, Z28830.1, AI621215.1, AI560075.1, AA603342.1, AA211203.1,
AI453000.1, AA505767.1, H29506.1, AI493165.1, AW338106.1, AW271945.1, AI561182.1, AI357213.1, AA888065.1,
AI950251.1, AA182641.1, AI750267.1, AW536810.1, AI893732.1, AA881079.1, AA833428.1, AA759435.1, AA274870.1,
AA260237.1, AI564193.1, AA172740.1, AA837350.1, AA572435.1, AA290546.1, AA563475.1, AA622090.1,
AW681468.1, AW261744.1, AA638984.1, AW107357.1, AW261646.1, AA170526.1, AA848235.1, AI873826.1,
M157598.1, AI750915.1, AI596266.1, AI929865.1, AI790736.1, AI649320.1, AI043196.1, AL023060.1, AW630831.1,
AI314622.1, AI314243.1, AI098095.1, AI043182.1, AA511211.1, AA434721.1, AA140498.1, AA098508.1, R74754.1,
AW532477.1, AI408553.1, AW750607.1, AV218438.1, AI048358.1, AA458054.1, AI763491.1, AV311575.1,
AV005809.1, AA091451.1, D58165.1, AI911938.1, AI548180.1, AA086929.1, AI581089.1, AW822437.1, AW208414.1,

TABLE 1-continued

Sequence homologies (GenBank Accession Numbers)

AW145984.1, AV159067.1, AI607800.1, AW535768.1, AI182297.1, AA313132.1, AA799539.1,
AI971805.1, AV209231.1, AV207950.1, AV154324.1, AV118302.1, AV175071.1, AC016552.5, AC009320.7,
AP001803.1, AP000479.2, AC027649.4, AC012429.4, AL353692.3, AC069214.1, AC024096.7, AC008670.3,
AC067813.1, AC021601.3, AC023659.2, AC023818.2, AC009009.2, Z97201.7, AP001815.1,
SEQ ID NO. 8
NGO-Br-57 combined;

AF025438.1, AL050353.1, AL121924.12, U42838.1, AL031055.1, AE003680.1, AC005539.1, AL121931.10, AL139076.2,
AL024458.1, AC004680.2, AC010889.2, NM_0070502 AF043644.4, AE003844.1, AE003787.1, AE003676.1,
AE003533.1, AE003519.1, AE003480.1, AE003422.1, AE003217.1, AE002799.1, AC004455.1, AC009320.7,
AC007478.1, AC007123.1, AC005966.1, AC005548.1, AL163232.2, AC000389.1, AL035633.18, AL032654.1, Z68335.1,
AL024473.1, Z92844.1, AL110503.1, Y18930.1, AP001687.1, AP001297.1, AP000459.3, AB005234.1, D17799.1,
D17798.1, D17797.1, X79080.1, AB009052.1, AB006621.1, AA701988.1, AI337332.1, AI765742.1, AI964006.1,
AI828070.1, M304319.1, AI760923.1, AA236789.1, AW161742.1, AI765022.1, AI935340.1, AW592648.1, AA865602.1,
M765999.1, N66532.1, AI631687.1, AA916723.1, AW161135.1, W58718.1, AA236836.1, N32746.1, AW051324.1,
AA024685.1, AW152251.1, AW772254.1, AA916358.1, AA313566.1, AI336121.1, AA024784.1, AW614505.1,
AI888263.1, Nfl163.1, AA007455.1, AW272790.1, AI167263.1, AI283104.1, AA451907.1, AA995467.1, AI753758.1,
AA505618.1, AI073755.1, AA913049.1, AI538205.1, AA670386.1, AI040719.1, AI352390.1, AA680352.1, AW151295.1,
AA720562.1, AI090162.1, AW466965.1, AA723980.1, AI808237.1, R72404.1, AI051040.1, AA992256.1, AI267913.1,
AA541923.1, AA532854.1, R41738.1, AA236656.1, AA928158.1, AW117185.1, AI630438.1, AA016221.1, AA345744.1,
AM37279.1, R72405.1, AI140745.1, AI084344.1, AI079153.1, AA852227.1, AA852226.1, H89982.1, AA000683.1,
AI539552.1, AA385531.1, AW427494.1, AW557853.1, N50079.1, AI461713.1, AA858049.1, AW536613.1, AI599140.1,
W10638.1, AI678339.1, AA637410.1, H30501.1, AW172462.1, R17187.1, AI630424.1, AI678340.1, R77800.1, W43974.1,
AI198148.1, N56244.1, AW433804.1, AI841918.1, H25699.1, AA003291.1, AL136131.7, AL355349.1, AL138706.1,
AL050335.24, AC016073.2, AC023651.2, AL354992.1, AC026285.4, AC055116.2, AC012133.3, AC006756.1,
AC012031.7, AC007953.7, AC027502.3, AC026747.3, AC008821.4, AC016635.4, AC008926.5, AC008924.3,
AC008592.3, AC009679.3, AC011639.6, AC016824.4, AC013237.1, AL356427.1, AL138899.6, AL160276.2,
AP000841.1, AP000783.1,
SEQ ID NO: 9

D26077, AJ009839, U00996, AF035621, AJ002223, AF013116, X57435, AF134401.1, AC004653, AL024473, AC004741,
AC004453, AL023806, U36562, U64849, AF016450, AC003689, Z77652, AJ223630, AF026029, M76713, AC006525,
Z70687, AL034351, Z94054, AC005955, U91325, AF051917, D90054, AF039047, AC003024, L123168, X89969, U21317,
W75604, W88219, AI390662. AA107502, AA959827, AA562519, AA139695, AI505854, C80964, AI646091.1,
AA217408, AU017533, W44823, AA381672, AI492198, M185468, AI630903.1, T86437, AA558491, AA216567,
AA368001, AA827488, AA425663, N84321, AA040741, AA084287, AA339843, AI524007.1, N73729, N75454,
AA025609, AI244351, AA489142, AI283076, W05252, T98110, AI244357, AA659485, AI266380, AA972439,
AI659137.1, D36418, AI065185, C67420, AA116198, AU000875, N98152, C56081, AU039284.1, AU039994.1,
AA948761, AI162556, C55758, AA406665, AI305146, AI368299, D39322, AI588173.1, AU001015, A56778.1, I32847,
A56776.1, I32846, A69720.1, I32959, I27064, I03683, I08248, E00136, I22490, AI8007.1, I08585, AI3479.1,
100031, I71463, A51384.1, I71462, I21102, I96207, I49950
SEQ ID NO: 10

AC005480.3, AC005031, AP000134.1, U80017, AL03131.1, AL022728, AC005777, AF037338, AC006163, AC005409.1,
AI003147, AC002476, AL022718, AL022323.7, AC004983, AC003085, AL022398, Z83841, AF134726.1, AC005534.2,
AC005532, AC005913, AC005828, AJ131757, AC002491, AC004150.8, AC000075, AC006511.5, AC000054, AC002430,
AC005231.2, AC003663, AC003108, AC005666, Z79996, X54516, AC004884, AL008583, AC004791, AC002477, U94788,
AC000092, AC004982, AL035419.9, Z73967, AC002347, AC002990, AP000111.1, AC004686, AC004891, AC002477,
AC004590, AC000086, AF039905, AL031286, Z81364, AC003070, AF001551, Z81365, AE000659, AB018295,
AC006561.8, AC006327.3, AC005622, AC005214, Z54246, AC002350, AC004797, AC005620, AC005212, AC005844.7,
UB5199, AC005664, AC006547.9, AC002519, AC002404, M34061, Z68330, U92009, AL021397, M63544, AC003664,
AL033524.1,1, D83402, AC004017, U48471, Z82174, AC005663, AC004785, AC000090, AL031407.3, Z96074.4,
AC005006, AC005531, AC004960, X71401, AL030995, Z97989, AC005581, M63543, AA501297, AU018489,
AU019533, AI413126, AI413410, AI503861, AA501217, W51648, AA516955, AA518598, W64166, AA823826, C88193,
AI174175, W61986, AI326216, C88111, AU043112, AA863851, W62377, AI430519, AI616330.1, C87922, AA501128,
AA516629, AA517646, C86532, AA.501262, C87864, AI272569, AA111730, M425687, AI042721, AI562135.1, W64884,
W77222, AA462890, AA797781, AV031046.1, AA409811, AI550652.1, W99885, AA116963, AA544786, AI649198.1,
AA097669, AA261001, AA542366, AI413859, AI324947, W70990, AA265787, AA967965, AA986868, AI647722.1,
AI646106.1, AA517461, AI648046.1, AI464652, AA217355, AA242458, AI507213, AI648110.1, AI648128.1, AA183349,
AA122689, AA734912, AA832680, AI325146, AA119201, AI573919.1, AA881598, AA986420, AA671469, AA666716.1,
AA867613, AI326422, AA881230, W18241, AA087547, AA915562, AA709758, AA217782, AA657012, C87438,
AI642202.1, W62449, AA959963, AA763337, AI286582, AA509536, AI593871.1, AI605818.1, AA204228, AU051781,
C79973, AA467249, AA398732, W38434, AA393394, AI358870, AA679523, AA345329, AI096496, AI049868,
AI159851, AA623010, AA815038, AI380153.1, AI282253, AA533025, AI589942.1, C14022, AA598954, T15722,
AA302658, F04710, W45306, AA322586, F04545, R36507, AI368853, AA663373, AA079076, AI431513.1, AA223512,
AI310992, AI300818, AA599074, W63553, AA573000, H86579, AA018923, AA344768, AI583291.1, AA012829,
T50676, AA808036, AI368732, H86221, AA019003, I184412, AI366180, AA768179, AA211734, AA244181, AA714073,
AI309121, AA343669, AA503018, N52293, AI591134.1, F35684.1, AI284543, AA748102, AI434365.1, AI251034,
AI251203, T53829, AI251284, AI254770, AI250552, AI054090, AA587826, AI246061, AI251944, AA573062, H40478,
T62078, AI620992.1, AA640310, AA633907, AA846923, AA642809, AI185394, AA378489, AI609972.1, T54783,
AA053463, AA741301. AI049630, AI537800.1, AA180775, I179453, I199700, AA632556, AI267356, AI306717,
AA766414, AI002762, AI628859.1, AI417586.1, AI635196.1, AI267450, R37503, R71796, AA318116, AA550283,
AI539956, AI066909, AI044039, AII45414, AI218793, H39328, W06387, H39389, AA107123, AI209314, AI151560,
W06750, Z69957, AI385339, M145871, AA849983, AI407780, D86779, AU057675.1, I139426, AI556681.1, AI549274,
AI236139, AI385214, AI231550, AA859752, AA979650, AI408895, AII70305, MI 72328, AI410991, M519994,.
AI230468, AI575399.1, AI575403.1, H39351, M599192.1, AI013893, AA900554, AA955084, AI603163.1, c21900,
AA850419, AI077076, AI411474, AI044422, D86656, AA899103, AI576270.1, AI489703.1, D48840, AI169234,

TABLE 1-continued

Sequence homologies (GenBank Accession Numbers)

AI163194, AI166186, M031502, AA799804, I34294, I76960, I40904, I40899, A47886.1, E12183, A62791.1, M1133.1,
I96203, A26415.1, A65890.1, AS1135.1, I05724, E03829, A47885.1, A28928.1, I62750, AR009805, I73182, AR014241,
I73181, I59642, A67988.1, I55948, I73246, A37262.1, I74786, I96182, A52294.1, A28005.1, AR000113, E02192,
A64529.1, A64531.1, A64510.1, I38891, I09380, I15767, I45974, I09337, I08110, E12647, AR002329, I25849, A70693.1,
AI9048.1, I08174, A22938.1, I34189, I02857, AR007159, AR007160, A67424.1, AR008154, I15157, AROO7118, I43096,
I43100, AR003505, AR016442, E03351, I76959, I36306, I23499, I18513, A58551.1, I41411, I16884, A43445.1, I07993,
I05479, I89273, E02252, E12964, A69986.1, I25678, I40313, E00140, A51134.1, I31097, I08711, I08101, E01888,
E02193, AR014384, A63257.1, AR020909, I47706, I93602, A63032.1, I17548, I96204, I08362, I17291, I01147, I02155,
I41409, AR016729, I92783, AR009214
SEQ ID NO: 11

AF021800, U10118, Z97198, Y08737, Y14947, Z60673, AL035610.2, X61295, AE000014, AC003018, AF037352,
AC004412.3, AE000663, AC003063.7, M33312, L24192, AL032632, AC005403, M97517, AC003997, AB020742,
X79073, AC003003, U21321, AC002181, X03095, AC004040, U80439, AE000664, AJ011763, AB002334, M84723,
Z74161, U40941, AC006031, Z49809, AF041853, AC004237, Z70753, Y14278, A3002005, Z49349, L26923, AI594998.1,
AA981629, AA242568, AI429115, AA218315, W75795, W30441, W75249, AA420074, AA798327, AA268851,
AIJ020128, AA435309, AU020212, AI413768, AA031103, W20836, AA048923, AA003813, AA792199, W61728,
AA014265, AA041914, AA771453, W77239, AM41822, W85151, AA537559, AA155051, AA114709, AA260917,
W85306, AA386560, AA718522, AA386635, AA511139, AA711462, AA117872, AA930871, AI122171, W75273,
AA138243, AA645328, AA120159, C79417, AA709995, W11155, AA068190, D21672, AA289897, W82402, AA881775,
AA711586, AV042196.2, MI82411, AV032023.1, W90821, AA683870, AA718618, AV017909.1, AA065744, D18760,
AA692504, AV031977.1, AA064500, AA073543, AA880781, AA118315, AI530605, AU044216, AA770994, AU045821,
AI591467.1, AI587681.1, AU045216, AU044215, AA727390, AI587682.1, AA770995, AA204486, AA796217,
AA716965, AA475324, AI019643, AU023053, AA710660, AA738810, AI324709, AA209984, AA183519, AA068031,
AI052246, AI559461.1, AA622031, AI332648, AA435714, AI492363.1, AA938590, AI092238, AI188366, AA778542,
AA455908, AI671681.1, AA582508, AA587478, AA397977, AA455165, AA456533, AI479525.1, AA456374,
AI652563.1, AI589034.1, AA810612, AA188088, AA503544, AI458348.1, AA528698, AI192386, AA566076,
AI431854.1, AA862906, H43129, H05377, AI130824, N40728, AI344800.1, N45576, C03104, AA352178, C0307 1,
AI392944.1, N48785, AA534079, AA657749, W25040, AA421615, R62721, N50217, D19778, F22451.1, AI308003.1,
AA204880, AA766513, AA204910, AA643643, AA621853, AA911790, AA724841, AI624242.1, R60744, AI500610.1,
AI203401, W56275, AI638598.1, N631.11, H49985, AI373287, AI191588, AI246039, AI381317, AA923262, AA874975,
M136838, AI45491.1, AI501868, H32629, AI330441, C23456, C06649, AI161984, D68580, AI177458, AI031457,
T14012, AI044756, AA944511, C70166, R90369, AI072460, H35675, T41601, AA955213, AA550022, AA684830,
AA686173, AI236174, I50092, AR024452, I47299, A09007.1, A47883.1, I28198, A47885.1, AR024451, AR024454
SEQ ID NO: 12

AJ006972.1, Z82097, AL008635, AC005290.3, Z82244, Y08741, Y08742, AF010146, M63544, M63480, M63005,
L29110, L26978, D25535, L26977, AB008180, AB008179, AB008178, AB011171, AB008181, AC0OS011.2, D86916,
U73647, AB008182, AB019435.1, D86993, D86917, AC003969, AA692113, AA760311, AA624213, AI316565,
AA163340, AA510098, AA572533, AI120898, AA410059, AI172900, AI323328, AA601526, W03454, CI5051, T08420,
H07047, AA314313, R60279, H56574, R13875, AI271346, R35102, H55150, R69765, H55342, AA780138, I136093,
AA199876, AA207191, AA101324, AA279681, T52837, N89391, AI367591, F32515.1, R68384, AI149946, AI568596.1,
AA725526, AI298130, AA291106, T10439, C16975, AA367318, M348687, C19853, AI575790.1, AU003722, AU003832,
H98311, I73389, I89388, A37795.1, E07536, I38852, I22507, I22508, I56094, I64893, I18362, AR009723, I08490, I05217,
A33685.1, AI2612.1, E12656, A70367.1, I95876
SEQ ID NO: 13

U58970, Z93929.1, AP114171.1, Z81360, AE001061, AL034562.2, AC004668, AF032734, AF010317, AC006054.2,
U08008, U23528, AA068863, AAOO8160, AA530777, AI325688, AI595520.1, AU035402, AA692569, AA061860,
W64597, AI035386, AA065497, AA250161, AA036616, AA896677, AA467612, AA008414, W71676, AA414908,
AA636533, AA466691, AI426325, AA681340, AI429169, AI006006, AI482274, AU022840, AI604817.1, AA930480,
AA726296, AI151985, W12938, W54805, AA220608, AA222025, AA269546, AA038987, AU040427, AU044915,
AI596350.1, AA563232, AA796461, W65676, AA423540, AA073134, AA198543, AA222283, AA259525, AA469501,
AI116855, W65005, AI173742, AA874364, AI060876, AA739143, AV016603.1, W58939, AA153672, AA117468,
W87996, AA537500, AI046820, AA017847, AI046923, AA647458, AA671738, AU015869, AJ019252, AU016054,
AV014010.1, AA541869, W82499, AA544042, AA793278, AA756503, AA743893, AI130910, AI086610, AA743858,
AI290656, AA131037, AI125470, AA745976, AA642908, AA457118, AA514531, W47335, AA976199, AI005635,
AI310405, AI138393, AI601160.1, AI188148, AA464084, AI459399, AA129925, AI268706, AI201189, AI038340,
W47460, AA131101, AA641641, AI138278, AA130705, AI567286.1, AA285110, AI208543, W16633, AA454154,
AA653333, R74396, AA932373, AA588644, R83918, AA292686, AA759367, H75519, R83919, D59308, H03960,
H68335, H79937, Z25102, AA678931, AI025455, AA641226, AI247225, AA729009, AA285013, H03153, AA887404,
AA781833, AA463949, H48272, AA514341, AA236001, R39018, AI041647, T80448, AI208401, H68336, T83268,
F05747, R57935, N78749, AA327260, AA761636, AA369899, AA129924, AI220922, T51048, H75520, T90735,.
AA319356, AA093579, AA916614, AI525914, AI381199, N93795, D78669, AA290835, AI538282.1, AA662813,
AA866145, AA064634, AA064700, T50985, H06928, AI375083, AA478496, AA322521, H35684, AA686648, AA686425,
AI412736, AI231571, AI602225.1, AA819360, AA893327, AA754214, AI007683, AI101399, AI144679, AA963591,
AI145971, AI555474.1, AA818417, AI008572, AI548931, AI145660, AI145729, AI070870, M145465, AI577487.1,
I17131, I71114, A43751.1, I48921, I17132, I15471j71115, I15472, I49533, I15009, A27345.1, E02290, A33017.1,
I15010, I15001, E05947
SEQ ID NO. 14
NGO-Br-60
MK746/T3 5'

NM_003311.1, AF035444.1, AF001294.1, AF019953.1, AC005950.1, AC001228.1, NM_009434.1, AF002708.1,
Y15443.1, NM_009344.1, U44088.1, AF192802.1, AF022148.1, U43930.1, U13369.1, M25718.1, AE001938.1,
AI006099.1, AD000014.1, X17403.1, Z84724.1, Z98260.1, U13701.1, M17225.1, M60560.1, AF239986.1, AF145729.1,
NM_007350.1, AC005836.2, AC004145.3, NM_007730.1, AE001851.1, AF195115.1, AC005060.2, U67167.1,

TABLE 1-continued

Sequence homologies (GenBank Accession Numbers)

AC004221.1, U92983.1, U67505.1, AF031880.1, AF013293.1, AL161472.2, AL161471.2, AL031722.18, U25652.1,
L22760.1, X82678.1, Z50194.1, AK001817.1, D49955.1, M25638.1, M13016.1, AI768117.1, AI290356.1, AW044158.1,
AW084115.1, AW015740.1, AI740612.1, M742439.1, AI073833.1, AI452633.1, AI863726.1, AI188588.1, AI309294.1,
AI741269.1, AI337297.1, AA479005.1, AI832162.1, AI741008.1, AI077667.1, AI129104.1, AI738908.1, AI766545.1,
AI277523.1, AA814143.1, R75643.1, H68978.1, AI565240.1, AA693763.1, AW084562.1, AI991120.1, AI689894.1,
AI492135.1, AI281966.1, AI200143.1, R75749.1, AW465323.1, AW463580.1, AI669214.1, AI298392.1, AW466053.1,
H68885.1, AI222900.1, AI422619.1, AA503237.1, AA989208.1, AW464723.1, AAOS7186.1, R68174.1, AI802724.1,
AA968817.1, AA502313.1, AI306416.1, AI802743.1, N29541.1, AA577052.1, AI253677.1, AA291981.1, AA976627.1,
AI991092.1, W30881.1, AA369394.1, T35140.1, T35135.1, AA113149.1, T35134.1, AA976558.1, AA293320.1,
AA477941.1, AW544396.1, AW544694.1, AW544044.1, AW543513.1, AW543163.1, AW537922.1, AA409046.1,
AA407959.1, AA153169.1, AA161891.1, W74902.1, AI029402.1, R24092.1, AA409059.1, AA056958.1, AA876081.1,
AW545407.1, D20894.1, AW538590.1, AA944922.1, AA014727.1, AI400179.1, AW765596.1, AI123706.1, AA407958.1,
AW761915.1, AI849120.1, AI840385.1, AA989987.1, AA596171.1, AI704218.1, AA965045.1, AC013791.3, AC021544.4,
AC023248.2, AC068006.1, AC069236.1, AC068881.1, A0068192.1, AC023572.3, AC026915.1, AC016174.4,
AC025630.1, AC010554.1, AC011630.2, AL353644.2, AL355134.1, AL158197.6, AC008891.6, AC024594.3,
AL133293.18, AC011611.9, AC011699.5, AC025913.2, AC015890.2, AC021218.3, AC016049.2, AC021675.3,
AC021528.2, AC012284.2, AC009887.4, AC024199.1, AC011699.4, AC011129.3, AL356072.2, AL160282.3,
AL355001.3, AL096855.24, AL354808.3, AL132867.12,
SEQ ID NO. 15
NGO-Br-60
MK746/T7 3'

AJ004801.1, M84465.1, M61143.1, AE003791.1, AE003450.1, AC006036.3, AC000093.3, Z82188.2, AL135745.2,
M31646.1, M34193.1, Z85989.1, AI279567.1, AI125808.1, AI743388.1, M554623.1, AI336185.1, AI768190.1,
AI394538.1, AI356687.1, AI279283.1, AA524259.1, AI140335.1, AI125797.1, AI858974.1, AI093933.1, M272028.1,
AI268851.1, AI042070.1, AA568684.1, AI338345.1, AW770516.1, AA776787.1, AA482453.1, AI191334.1, AI813413.1,
AI352347.1, AI042254.1, AI268758.1, AA532627.1, N68172.1, AI160353.1, AA931805.1, M343021.1, N68196.1,
AI077948.1, AA705334.1, AW327781.1, AI198251.1, AA721003.1, W05193.1, AI830795.1, AA481706.1, AA715390.1,
W58698.1, AA417821.1, N68260.1, W58215.1, AW439353.1, W69215.1, AI281960.1, AI800014.1, N89605.1,
AW071418.1, AW517028.1, AI298093.1, AW149380.1, AI369601.1, AI191106.1, N54740.1, AA428492.1, AI074994.1,
AA976989.1, AA057072.1, AA976789.1, HI 9993.1, H02830.1, AI298398.1, W58699.1, R69545.1, I127894.1, T35392.1,
AI370680.1, AI206775.1, H20384.1, AI261835.1, AA603925.1, H83921.1, H50256.1, AA740592.1, R62272.1, W07471.1,
AA471035.1, AA328860.1, R69416.1, AI184456.1, R96832.1, AW000778.1, AI207043.1, W58105.1, W80558.1,
AA522968.1, N75444.1, AW291022.1, H63728.1, I120193.1, AA887675.1, AA853980.1, AA771899.1, D25746.1,
AA976567.1, W80428.1, AL136379.2, AC026443.2, AC008961.4, AC051636.1, AC024447.2, AC026065.3, AC026270.2,
AC025804.2, AC022953.2, AC013624.4, AC022315.5, AC009218.6, AC016019.3, AC022030.1, AC014982.1,
AC020202.1, AC007837.3, AC007913.1, AL158151.5, AL161785.4, AP001120.1, AP000405.2,
SEQ ID NO. 16
NGO-Br-68
MK442/T3 5'

AF141968.1, AB033077.1, AB029290.1, AF150755.1, U67205.1, U67204.1, U67203.1, NM_016615.1, U76343.2,
NM_003263.1, U88540.1, AL161557.2, AL009028.1, D13637.1, AL021635.1, AI734450.1, AW865983.1, WK531012.1,
AW405405.1, AW148645.1, AI583168.1, AI290663.1, AA451993.1, AA302993.1, AA297912.1, AA288614.1,
AA178091.1, R78273.1, AW816433.1, AW816426.1, AW290918.1, AL133903.1, AV221162.1, AI504039.1, AI403713.1,
AI238618.1, I123080.1, AL356055.1, AC019071.3, AC061993.2, AC068911.1, AC025594.3, AC009546.3, AC010537.2,
AC01 0687.2, AC010090.3, AC004229.1, AL354956.1, AL162405.2, AP001098.2,
SEQ ID NO. 17
NGO.Br-68
MK442/T7 3'

AF141968.1, AB033077.1, AB029290.1, AF150755.1, U67205.1, U67204.1, U67203.1, AC006299.1, AE003771.1,
AC005670.1, AJ277889.1, AL121988.10, AC00D111.1, AL031599.1, U27560.1, Z99112.1, L08471.1, AC009415.2,
AE003507.1, AC006971.2, AL163258.2, AL135879.1, AL121790.2, AL139074.2, Z35640.1, AI248288.1, U51998.1,
AP001713.1, AP000178.1, AP000034.1, AP000266.1, AP000102.1, AC009236.4, NM_014514.1, AF105235.1,
AF104852.1, AE003845.1, AC005137.1, NM_004857.1, NM_003672.1, AF165124.1, AF103013.1, AF103011.1,
AF103010.1, U73396.1, AF071085.1, AF022044.1, AF001881.1, AF000367.1, AL132773.14, AL132793.24, AL162691.1,
AL049588.11, U30274.1, AL035475.6, L76664.1, L76661.1, I41269.1, X97232.1, X97233.1, X94262.1, M90359.1,
AB013389.1, AB010073.1, Z99120.1, Z21839.1, AA418046.1, C43219.1, AW565904.1, AW287353.2, AW285203.1,
AW283675.1, AI948261.1, AV165647.1, AA393617.1, Z29935.1, A0068280.2, AC009416.2, AC008414.1, AC013858.1,
AC007893.6, ACZ007892.3, AL121993.6, AL122010.2, AP001002.1, AC055822.2, AC068120.2, AC020995.2,
AC036118.2, AC068104.1, AC025117.2, AC027113.2, AC067758.1, AC018587.3, AC012693.1, AC007513.13,
AC021104.2, AC068921.2, AC068883.1, AC025459.3, AC008684.4, AC026178.2, AC060785.1, AC053491.1,
AC041008.1, AC034223.1, AC008706.2, AC027134.1, AC019101.3, AC026193.1, AC026187.1, AC026171.1,
AC021696.3, AC015611.3, AC021556.3, AC021287.4, AC018810.2, AC015475.3, AC017113.3, AC019027.2,
AC015011.1, AC010073.1, AL139137.2, AL163543.2, AL122035.2, AL158038.2,
SEQ ID NO: 18

M90814, M86183, D16309, U82832, M88085, M88086, M90815, U43844, U49935, M88087, U47285, M88084, S78355,
M64403, M73554, M74092, Z23022, X59798, L09752, D14014, X75207, D16308, M90813, X68452, X89475, U28980,
M88081, X87581, M83749, M86182, U87099, M91003, U40844, Y10075, X89476, AF037570, X83503, U79301,
AJ236635, U14950, U93309, AF010496, AC004530, AF085248, S54563, I48803, AF017112, U16789, AF109069,
Y17214, AI322454, AA051245, AI122217, AA118092, AA597177, W97516, W40624, W63869, AI097883, W34342,
AA199092, AA117687, W65166, AA797053, W10608, AA033206, AA062207, AA796967, AA793825, AA000419,
AA028593, AA014268, AA033005, W48284, AA881788, AA771036, AA796947, AA670841, AA008831, AA271986,
AA002975, AA111431, W59174, AA396492, AA727608, W61835, AA591109, AA797087, AA062020, AA499515,
AA210201, AA123883, AA914952, AA682134, AI323180, AI325829, W79998, AA881818, AA657272, AI324083,

TABLE 1-continued

Sequence homologies (GenBank Accession Numbers)

AM 11722, AI528899, AA711810, AA269978, AA060924, AA060518, W53383. AA105418, W71681, W53854, AA930561, AA116586, AA034898, W54260, C81477, W82409, AA124938, C79771, AA560551, AI323871, AA269913, W09396, AI503391, AA467356, AI322927, AA396728, AA153736, AA472900, AA512802, W90890, AA733955, AA682053, AI181456, W08991, AA002467, AI426307, C78795, AA140358, C81516, W10677, C80994, AV012985.1, W98440, W97358, AA726582, AA655786, W75724, AA646393, AI592902.1, AA276376, M356287, AI436372.1, AA634212, AI452828.1, AI276632, AA975277, AI371720, AI080403, AI399960.1, AA478420, AA278460, AI287846, AI362073, AI347606, AI363127, AI279553, AA443513, AI130809, AA402345, AI365032, W31908, AA480461, AA398785, AI143359, AA988118, AI648542.1, AA195505, H89623. AI567387.1, R70362, AA195376, AI383816.1, N94440, W39271, I189477, AA506987, W24758, AA428380, W02748, T27682, AA400851, N32310, N57406, AA380350, C00443, W94407, D58595, AA361389, W21508, AI475678, AA380681, F28617.1, R70363, AI270923, AI340905, N93040, AI251663, AA334005, AI336519, AI254005, F20264.1, AI312391, F37177.1, AI311447, AI311448, AA160146, AA335701, AA283255, W30788, AA160147, AA165301, N36623, W94406, AA226806, AA100854, U47703, AA866574, AI086542, AI278890, AI190622, AI382164.1, AI499061.1, AI347077, AA402387, AI085348, AI568929.1, W60380, AI274886, M183918, AI571777.1, AI023701, AA112340, AA126942, AA227161, AA906539, N75459, W60289, AA160820, R91955, AI230696, AI408565, AA900873, AI100977, AI175996, AI104322, AI013336, AA850467, AI231788, AI236125, AI171927, AA891743, AA958014, AA955666, AI228950, AA957218, AI011931, AI030214, AI407630, T15257, AI177145, H34217, C06758, AA519689, AA851383, AI114164, AI045153, AU010436, AI487549.1, AI238469, I96214, I23762, E03080, I75252, I34034, A27260.1, I41421, I34031, I75356, I75254, AR014269, AR014271, AR014272, I73180, A67848.1, I25678, I16616, I73182, AR014270, I41349, AR014241, A09995.1, AR014273, A26437.1, I20505
SEQ ID NO: 19

AF035950, AF035620, AC002126, X78504, AC004014, X82039, AB015469, X89558, AF083424, AC0O4617, Z82189, AC007055.3, AC005247, X89535, AC006530.4, AF083069, AA792693, AA726783, AA771149, AA518210, W14021, AI390859, AA342139, AA877660, AA828666, T87569, W60401, AI640567.1, F30242.1, AA862855, AA995857, AA669837.1, AI242161, AA743161, AI340251, F22148.1, AI632625.1, AI151418, AI637787.1, AI608941.1, AA186698, AI075293, AA173985, AI292110, AI373314, AA100913, AA522692, AI590809.1, AI524808.1, AA295949, AA182705, AA160675, W46673, AI650925.1, Z43839, AI332985, AA995455, AA129593, F26241.1, AI272109, W60310, AI347479, M080003, AA834774, AA694518, AI346936, W42415, N49848, AA001202, AA773564, AA031697, AI659936.1, AI640340.1, AA129330, I166266, AA817737, AA841970, E02685, I46903, E02810, A70722.1, A58497.1, A58525.1, A58521.1, A58526.1, ARO0950O, A58523.1, A70697.1, A58522.1, A58498.1, A58524.1, I36936, AR013983, E12486, A68194.1, I50036, I13539, I50038, E12631, A63583.1, A39440.1
SEQ ID NO: 20

D83260, X87199, D83261, L44140.1, X74611.1, D83388, D83389, AF012071, Z66565, AC004736, U78310, AF009620, AC005006, AF102139.1, X98173, X98177, M96823, X98172, U58143, X98178, X98176, M14220, AF110004, AL031640.1, D10667, AC005831, AC005887, AB020673, L27155, AB023482.1, M69181, U31463, X13586, L09104, M77482, L16993, AF001548, M510573, AA145965, AI155964, AA492660, AU035834, AA060937, AA265452, AA171056, AI326531, AA435069, AA512465, W14241, AA102994, AA062157, AI315360, AA183741, AI036559, AA409062, AA473920, AA260266, AA434684, AA389221, AA797841, AA919576, AI528817.1, AI036001, AA027647, AA165848, AA683821, AU041887, AI390165, AI152568, AI605728.1, AI122032, AV045840.2, AI195545, AA000224, AA389213, AI255740, W18089, AA619651, W64485, W87140, AA060933, AA241200, AA445791, C77979, AI664303.1, W85405, AU041902, AA510701, AV044861.2, AA000159, W07980, AA157345, AA083878, AA053735, AA312864, T62991, AA374540, AA969971, AA370067, AA584930, AA584911, I75223, AA573791, AA595492, AI207763, AA043275, AA629772, AA907439, R32740, AI625774.1, AA312258, AA128875, AI245951, AA092288, AA482992, T07180, AA306254, F08778, AA491093, AA114049, T74054, AA206475, T16890, R73497, R51754, AA426585, AA888565, AA984237, AA412321, AA664001, R55849, AA214456, W46645, AI572049.1, AA074593, AA176605, AA412665, AI354431, AI268841, AI437247, C71174, C91867, C91635, AI011621, AA390379, Z47662, AI516015, AA686693, AI231448, AA201957, AI235217, AI258748, AI408532, AI294149, AI104095, AA950318, T82761, M79660, C50053, AU064512.1, AI238267, AI178066, C97290, D74869, AU057911.1, AI295595, AI658254.1, AI063708, AI296592, AI477740, C20354, C41837, AU029982, AI404208, C44430, M514088, R89934, AI107270, AA202366, AI295756, AU054048.1, AU057892.1, D75473, C43065, AU034393, AI148383, AI106670, I82207, F06625, E04317, I82202, I64540, I08607, I66263, E06231, A58497.1, E06246, E06232, E06233, I15824, A58522.1, I15975, AR007585, E06234, A58521.1, E06226, AR007590, A62340.1, E06261, E06235, E06248, A58523.1, E06247, A58498.1, A46716.1, A58526.1, I96211, A64582.1, I01254, A25492.1, E05192, I68138, A09962.1, I30482, E04845, I01251, I01212, AI5671.1, A20861.1, I21938, E00989, A39477.1, A20359.1, A52091.1, E00359, E08423, A39482.1, I01215
SEQ ID NO: 21

D83260, L44140.1, D83389, X87199, X74611.1, AC006264.2, Z59309, AB019440.1, I163131, AC004983, AC005094, AC006202.2, Y18450.1, AL022314, Y17037, M63495, U43077, AF095935, AC004398, AI155964, M510573, AU045922, W33799, W42362, AA960516, AI664149.1, AA688562, AA467205, AA595492, AA573791, AA629772, AI332743, AI160935, AI510778, AI591019.1, AI457159.1, AA969944, AI539436, AI623125.1, AI188940, AA713971, AA610104, AA706786, AA582464, AI567836.1, AI207763, AI358329, AI157250, AI582710.1, AA744976, AI638507.1, AI039843, AI571784.1, AA640190, AA194089, W58500, AI565383.1, AI381941.1, AA053629, AA480214, W58535, AA503086, AI640364.1, D51182, AA253436, AA250750, AA112892, AI025123, T63135, AA969971, AI610993.1, AI207764, AA024425, AA935715, AA385688, AA043276, AA374540, AA083878, T62991, D31140, AI274547, AA775760, AA252726, AA522501, AA987599, AA172101, AI358015, AA092870, AA412321, T11978, H86668, AI247739, R06066, T86931, I186515, H39234, AA064937, AI502660, AI106368, AI444536, C23347, AU056970.1, I132742, C93950, T37393, AI238361, R04882, T38016, C91449, AR009920, I09636, I23493, I09629, I40358, A22940.1, I12873, A40345.1, AR022373, AR022395, A22942.1, E13132
SEQ ID NO: 22

D83260, X87199, L44140.1, D83388, X74611.1, D83389, D83261, Z80360, Z99123, AF021936, AB003364, AB011110, AC004084, U61295, J00752, Z48794, AF098760, X15938, X15939, AL031155, U15803, AB024929.1, U78289, M86719, X07273, X78898, AL023861, AE000979, X59602, AR19361, US1167, Z71483, AL008627, J00751, AI510573, AA518721, AA770719, AI155964, AA919842, W71911, AA208368, AI527584, AA530827, AA589702, AA050630, AA117695, W75487, AA645964, AA165828, W70754, AA734295, AA958490, W34195, W42215, W17699, W41966,

TABLE 1-continued

Sequence homologies (GenBank Accession Numbers)

AA014247, AA042019, AA041712, AI019834, AA833404, W85670, W13027, W54346, AA000184, W89228, W97044,
AA270388, AU023492, AA276667, AA498405, AA254932, W61466, AA048354, AI391391, AU043001, AA073884,
AA268731, W89303, W36983, AA049172, W08238, W42151, AA041974, W42212, W74851, W10543, AA268680,
AA043275, I75223, AA385688, AA043276, R56012, AA312864, AA053735, AA083878, AA157345, AA969971,
AA595492, AI207763, AA573791, AA969944, AI332743, T27009, AI160935, AA374540, T62991, AA584930,
AA584911, AI207764, AA629772, AA706786, AA713971, AA744976, AI591019.1, AI188940, W58500, W58535,
AA194089, AI539436, AA157250, AA524052, AA887388, AA380353, AA354269, AA658541, H22719, AA654864,
AA355097, AA776602, AI660486.1, AI437247, AI444536, AI106368, AI062974, AI231806, AI388676, AI577001.1,
AI576976.1, AI579074.1, AI388808, M135072, AI579223.1, AI579480.1, M579646.1, AA859295, AI578880.1,
AI579275.1, AI602634.1, AI579680.1, AI455073, AI114110, AA696762, AI455992, AI063030, AI515739, AA949809,
AI064036, AI064095, AA735407, AI292518, AA201662, AA201417, AA940989, AI519254, AA438981, AI534698,
AA940891, AI456973, AI457018, AI516535, AA438754, AI259864, AI134507, M516225, AI456244, AI133981,
AI512793, M546711, D40443, AI456517, AA392775, AI455781, AI443222, AI135061, AA941157, AA735719,
AA950551, AA942246. AA264588, C25459, C25152, AA390551, AI257135, AI386867, AI456885, AA202866, AI512216,
AI513060, M518575, AI520297, AI541707, M542062, AI543888, AA951861, AI546617, AA949071, AA941206,
AA735659, AA942105, AA438590, AI542988, A61947.1, A48810.1, A48829.1, I18491, I28510, A20359.1, I08146,
E02372, I41422, E03013, E08097
SEQ ID NO: 23

D83260, D83389, L44140.1, AF020515, Z98304.1, AC004960, AL008630, AC002080, U29874, Z86000, AC005669,
AC005513. AC004812, AC005414.2, AC003669, Z83822, AB008539, U91318, U81831, AL031255, AL022726,
AC004724, AC002121, AC002402, Z92540, AC004722, AF098501, Z74618, AB020863.1, AC000386, AF064384,
AB005166.1, AC003012, AC005474, AC007031.2, AB003306, AC000400, AC002558, AU045922, W33799, AI155964,
AI510573, AI480534, AI643147.1, AI506184, AI019969, AA840485, C77168, AA987173, AA510625, C77404, AI509236,
AI480531, AI614092.1, AU040587, AA537364, AA792818, AA518281, AA718656, AI466011, AA170450, AV047994.2,
C88019, AI606196.1, AI607367.1, AI642000.1, AA821665, AI605163.1, AI035496, AA930386, AA563411, C77540,
AI020864, AA464370, AA161901, AI504453, AA175915, X83327, AA518371.1, AI050535, AA617383,
AA830135, D31140, R56577, R56013, AA043276, AA385688, AI457159.1, AA582464, AI381941.1, AI567836.1,
AI623125.1, AI510778, AA250750, AI160935, AA640190, AI188940, AI638507.1, AA194089, AI207763, AI539436,
AI565383.1, AA744976, AI358329, AI582710.1, AI039843, AI591019.1, AA595492, AA969944, AA480214, AA713971,
AI332743, AA706786, AA629772, AA157250, AA573791, AA253436, AI511784.1, D51182, AA610104, AI640364.1,
AA503086, W58535, W58500, AA053629, T63135, AA935715, AA024425, AA134908, AA112892, C15370, AA281263,
AI381897.1, AA420753, AA420795, AI085414, R02067, AA514630, AA251347, AA555042, AI290561, AI609569.1,
AI290637, AA780972, R94646, N75756, AA496622, AA865459, AI052038.1, W22175, AI633397.1, R33150, R98500,
H84166, AA927464, R40243, AI431867.1, AI468668.1, R43249, R98518, N31247, AI081773, R43320, AA457416,
AI502660, AA835613, AI007384, M106368, AI388746, AI615179.1, AI070388, AI169616, AA866335, AI412695,
AA875253, D65481, AI112231, I176868, AA686507, AI406709, AI502340, AA850799, AI170499, AI579107.1,
AA898409, AI398060, M399625, AI410463, AA901297, AI329998, AA898608, AI602826.1, AI412666, AA849825,
AI412543, AI080878, AA882998, AA898981, C56533, AU005190, AI231961, I86417, A63573.1, I86415, I86416, I01852,
I47056, I19103, A38528.1, A23425.1, A63257.1, A64062.1, A68826.1
SEQ ID NO: 24

U37359, AF022778, AF073362, U58987, U60315, AF134569.1, AB010695, AC004472, L44117, Z73978, AC005746,
AL008638, Z69792, AB013852.1, Y09629, AC006266, AF014953, AI037147, AI115949, AI561969.1, AI550158.1,
AA114813, AI132067, AV001773.1, C76688, AA203842, AA208254, AA711715, AA206653, AA243252, AA706080,
AA772644, AI208691, R69461, AA112856, W23633, W86391, AI360182, AI640178.1, AI076395, AA658420, AA327854,
AA333526, AI204278, AI369362, AA440659, AI389561, AA264398, AA539320, AA264980, AA820331, AI513019,
AA942402, AI513643, AI389955, AI543536, C70910, AI576108.1, AI070374, AI576338.1, AA231815, AA750795,
AI511175, M638933.1, AI2984.1, I25119, A68700.1, A67171.1, A52398.1, A47886.1, I46761, I46762, I46764, A47884.1,
AI4577.1, A52411.1
SEQ ID NO: 25

AF022778, U37359, AF073362, U58987, U60318, AL021747.1, AC003672, AC002062, Z95889, AC006566, AB025613.1,
AC003683, AC004442, AP000075.1, Z25809, U44405, AL009029, X63648, AC002460, AE001413, AC006434.5,
Y14850, L19354, M33212, AB005234, AC004526, AL049497.1, Y14851, Z82195, AC003101, D16583, X89514,
AL021710, D16247, Z83235, AL008983, AL031771, AF107888, Z86094, U24152, AB007035, AC002560, Z99570,
AL031018, AF142341.1, AF030304, AB006707, AF071884, AF059614, AB023032, Z36752, Z99261.1, X91660,
AB026658.1, U53878, Z73286, AC002131, AC005508, AF079100, AI323787, AI132460, AI020209, AA204495, C79846,
AI035620, AA536853, AA571383, AA591270, AA217733, AA555938, AA675244, AA921674, AA563506, AA450435,
AA920930, AA537092, AA109126, AA589003, AA529573, C77471, AA591634, AA116739, AA588978, AA474888,
AA117106, AA529304, C79021, AA591480, AA162184, AA155089, C77839, AA709489, AA466880, AI642311.1,
AA410111, AA265133, AA589145, C77072, AA575522, AA522389, AA285751, AA624447, Z74635, AI314712,
AA522068, AI652139.1, AI288910, AA206223, AA974008, AA599357.1, AA932162, AA807167, AA599453.1,
AI637591.1, AA034479, AI572202.1, AI650940.1, AI276014, AA614182, W03632, AI592123, AI206893, AA988287,
AI263519, AI242564, AA506923, AI468356.1, W24658, T18886, AI298371, AI277646, AI192319, AA995617, F36736.1,
AA984490, P26599.1, AA827292, AI081822, AA872582, AI160205, AI478625.1, AI601129.1, AA983916, AI097123,
T34012, AA279924, AI160742, AI300440, AA482258, F20966.1, H78681, AA468562, AI003164, AA984955, AA526574,
R59956, R30773, AA082029, W87821, AI671687.1, R88644, AA361315, AA136572, AA354831, F36398.1, AI200035,
AA974192, AA642957, AA745017, AA378797, AI023066, AI200585, AA715425, AI609596.1, D20944, AA852795.1,
R16278, AA576140, D79290, N22521, AI352221, AI216109, AI197929, AA887382, AA027293, AA635177, AA504590,
AA480240, N92237, R07135, AI362945, AA932636, AI193810, AI088110, AA873539, AA682471, AA057620, AI186151,
AA433405, AA946133, AA945897, AI328451, AA597601, D39329, D24519, AI407294, AI164605, AU061968.1, R30034,
M544517, C93933, AI328337, M513801, AI164274, AU002123, AU033967.1, AU052365.1, AU060842.1, AI011217,
AU037894.1, C88403, M477124, AI497314, R65553, AA957838, AU037725.1, AI398683, AA940687, AA218507,
AA940686, AI239179, AI398762, C23834, AI330907, AI385079, AI511966, AI600787.1, AI677358.1, AA949936,
T02776, C68683, AA940791, AI059084, AI577660.1, AU039812.1, AI397898, AU061886.1, AU061571.1, AU034262.1,
D69160, C41317, H37462, C70179, H35888, C70908, I76738, W06653, AI397213, AA657313, AI616684.1, AA949937,

TABLE 1-continued

Sequence homologies (GenBank Accession Numbers)

AI584979.1, AI063744, H37390, AR003149, A32895.1, E03799, E03335, AR019675, I66313, I70400, A56817.1, I70401,
A29216.1, I75422, I14183, L75423, I14195, I78761, I36465, I75427, I75419, I14194, I75420, I75421, I75418, A64703.1,
A08586.1, E08933, E00023, AR020964, I03286, AR00003O, A64697.1, A64699.1, I03284, A01114.1, A29490.1, I08707,
I95887, AI3481.1, E02253, A64701.1, A64705.1, A37615.1, I40371, I00547, AR022373, AR022395, AI0398.1,
A00785.1, A29462.1, A00783.1, A00784.1, E01948, E06147, A29450.1, A02353.1
SEQ ID NO: 26

AC002553, AC006251, M97203, X73411, AF101041.1, M29293, J05497, X73410, AL008635, AF003740, AL031254,
Y00067, AB026660.1, Z82097, Z79599, AB011175, AE000560.1, AA816006, AI604002.1, W98579, AA691918,
AI526343, AA023167, AA143467, AA733106, AA314502, R17289, H83769, AA345370, T89569, AA358953, AA085316,
AA094893, W19892, W67454, AA247110, T82156, R10398, T86771, W73280, AI565243.1, AA080941, AI262599,
AI263992, AI459026.1, AI492668, AI472115.1, AA933958, AI346037, AI241111, AA782623, AA019887, AI346519,
AA282333, AI244882, AI278691, AI476679.1, AI214189, AI347107, AA333501, AA836617, AA814709, AI214203,
AI492667, AA400732, AI475840, AI298541, AI494464, AA741043, AI264537, AA969965, AI285048, AI199041,
AA354148, AA767553, C15272, AI475846, AI304338, AI247325.1, AI148129, AI041910, AA810941, AI348239,
AI291169, AA321958, AA678406, AA837209, AI146344, AA504327, AA676467, AA778410, AA846401, AI000419,
AI024340, AA243430, AA352048, T64486, AA702872, AA847107, AI087243, AI126049, N40801, AA147393,
AA679468, AA972167, AA434089.1, M538766, W96128, AA424294, AA451743, AI123660, AI148484, AI291369,
T87406, AA810716, AI339925, AI480039.1, AA999044, AI235929, AA799285, H33618, C94017, AI353449, AA696367,
AI353548, c28625, C28643, C93526, AI406656, C28285, C50677, A62358.1, A66650.1, E12861, AR013984, A57089.1,
I81174, A60173.1, I33396, E13833, AR020969, A66552.1, A58853.1, I81173, A66553.1, I13892, A66559.1, I81171,
A22128.1, A58859.1, A69288.1, I31095, A58857.1, I58526
SEQ ID NO: 27

AC002553, U54734, AC004274, Z68131, U55375, Z82269, AF052106, AL031577.1, AC004098, U36756, Z73496,
AB0256311, M23221, AE000720, AL021749, D90912, AC002292, D86972, AA286643, AA522304, AA276944,
AA065695, AI614802.1, AA648520, W67727, AA845447, AA700588, AA173197, AI609605.1, H97578, AI553914.1,
AI361073, AA582850, AA426042, AA830128, AI367388, AA143466, AA757234, AA587480, AI017352, N66936,
AI126939, AI245298, W67455, AI471199.1, AI457988, AA402248, M189983, AA954621, AI245792, AI200305,
AA412060, D59326, AA725312, AI635986.1, N93123, AA962148, AI200033, AI399677.1, AA984035, AI302396,
AI472786.1, AI362644, AA732015, W72025, H97759, c20580, R07575, W38649, AI085824, H83910, AI268814,
R41966, F28077.1, W77754, AA826770, N91239, AI540736.1, AA279082, AA530936, AI382402, AA481472, AA169367,
W67726, AA677793, AA330071, AA860559, AA700804, AA609563, T81813, R57954, R69408, H 15627, H27566,
T08883, AA297639, AA775768, T80751, AI420322.1, N31794, R68955, W05645, W67440, AA004779, AA583615,
AA919107, AI589258.1, AI609518.1, R39975, AA100117, AA156830, AA158743, AA621667, AI074233, C17813,
AA995310, AA781230, AI304724, AI357834, AI608891.1, AI625220.1, AA523124, AI576440.1, AI130322.1, AI227616,
AI104145, AI007878, AI044248, AI176979, 03288, I08092, I04632, AI8397.1, 01467, A21571.1, A09202.1, A35395.1,
AI1978.1, A04029.1, I27552, A27355.1, I40899, I14076, I40904, I00848, E00038, I74777, E00178, A45315.1, A41946.1,
E07874, I43726, A32988.1
SEQ ID NO: 28

U48734, U19893, D26597, AF115386, X15804, Z36797, X55187, AF093775, U41416, X13875, J03486, J02666, X62075,
M74143, U41415, X13874, X59247, X51753, AL009192.1, Z36782, 566283, AC004560, AC005764, M65149, M86804,
M85144, X61800, D82986, X68797, AJ011924.1, AJ011925.1, M19364, M92288, U28387, Y11521, U00913, AF029667,
M55075, M20391, AF049659, AC006271, AE000876, Z84819, AF049658, AI132340, AA039109, AA030873, AA050600,
AA869608, AI116806, AI317336, AA265060, AI019642, W57010, AA033333, AA756213, AA497523, AA794222,
AA607852, AA542357, AA867351, AA389009, AI099223, AA760101, AA733888, AA636878, AA033327, AA048059,
AA591043, AA4.67049, AI119186, C79156, W91243, AA718206, W98655, AA823795, AI035958, AA245084, AA939627,
AA163055, AA792854, AA795384, AA469849, AA399735, AA403949, W98201, AA711821, AA207952, AA002732,
AA718655, AA276564, AA597111, AA590753, W99855, AA221916, AA726158, AA013805, AA840112, AA760104,
AA571361, AA794950, AA606423, AA755071, AA591998, AA608344, AA286001, AA144320, AA119163, AA267688,
AA591115, W14056, W09813, AA790706, AA672798, AA915160, AA239694, AA407975, AA068062, AI596211.1,
AI592346.1, AA986495, AI117698, AI035704, AA023969, AI006572, AI156861, AI114974,
AI663151.1, AI037172, AI173796, AI119115, AI118977, AI035788, AI006532, AI036719, AI156861, AI114974,
AI131659, AI119198, AI151787, AI037056, AI151785, AL047603.1, AA129723, AI338492, AA709156, AA583155,
AA580212, W65372, AA741013, AI453778.1, AI564985.1, AI568972.1, AA312012, AA658060, AI273379, AA130451,
C18172, AI309142, c06273, AI420716.1, AI147600, AA984144, AA658055, AI653971.1, AI283351, AI433966.1,
AI205107, AI9359354, AA635973, AA476888, AA149934, c06155, D83843, AA804798, W61307, AA079279, N94729,
AA888055, AA864433, F 18836.2, AA857188, AA968700, AA860502, AI494454, AA769091, AA368907, AA664019,
AA604905, AA057696, M85377, AA148549, AA938518, T08563, AA080946, H00427, R20827, R66641, AA834121,
AI141654, AA134086, H28790, H25414, H00428, H00955, R94564, AA552159, AA969217, AA514914, AA830417,
R20782, AA514919, AI128943, AA079449, R52047, R20891, R52046, F16280.2, T49685, H46560, R42007, AA147199,
D82247, T08562, AA852880.1, AI590894.1, AA988093, M62209, R27898, H28764, AA160770, AA928567, AA737577,
AA723515, R72373, R94565, T69050, AA551753, C18948, AA328220, AA683006, AA309633, AI548249, AA063656,
AI496971, AI544547, AA848941, AA800206, AA080817, AA925873, AI178827, AA944553, AI230168, H33963,
AI011763, AI231061, AI235159, AI012057, AA567651, AI010583, AI073202, AI176994, AA697902, F23022, AI518443,
AI044058, AI555472.1, AA926277, AI177468, AI578284.1, AI176108, AI230571, AA696880, AI229787, AA900462,
AI232283, AA946292, AA924731, AA720416, AA956707, AI176576, AI179210, AA955493, D34804, C60739,
AA264106, AA263778, AA439762, C63031, C63929, C64397, AA800218, AI137505, AA390645, AA567595, AI385099,
AI453974, AA849747, AA940720, AI384290, AA439198, AI106351, AI331439, AA698095, AI456910, AI175096,
AI330989, AI331314, AI332152, AI354002, AI294443, AI331926, AI330468, AI330546, AI411001, AI010821,
AA698489, AA698488, D35859, AA950468, AI618130.1, AR018763, AR018849, AR018781, E05171, A70393.1,
A67852.1, A67854.1, A70394.1, A70392.1, A63599.1, A07822.1, A70398.1, A63600.1, A70382.1, I14942, A63605.1,
A70384.1, A40404.1, I33090, A40408.1, A63607.1, A70388.1, A70408.1, A40410.1

TABLE 1-continued

Sequence homologies (GenBank Accession Numbers)

SEQ ID NO: 29

D80007, AF055668, AF055669, U21688, D00702, AF021240, AF123593, X70842, X59397, S53103, AF021242, AC005662, AL023096, AA510676, AA64551.1, AA870137, AI154187, AII55985, AI613826.1, AA028338, W44001, AA511476, AA230933, AI481396, AA413046, C89275, AA537279, AA617451, AA517438, W41139, AI415395, AA675301, AA863640, W14583, AI603915.1, AA143972, AI326261, AA675300, AI272487, AI585489.1, W10702, AA929866, AA796560, AA124404, AA413714, AA615566, W34183, AV032204.1, C88996, W64978, AI430527, AV030110.1, AU042246, AA544765, AA267175, AA560701, AA592382, AA981828, AV006873.1, AA638757, AV028681.1, AA407227, AA254801, AA839868, AI182089, AA238693, AI426414, AU016037, AA108899, AA274574, AU042862, AU016038, AI182079, AI662025.1, C87674, AA536770, AV026581.1, AA185650, AA541940, AA546749, W33384, AA792080, AA154814, AI160467, AA595718, C18820, AI208315, AA666405, AI129469, AA548980.1, AA564369, AI493057, AA480184, M671557.1, AA424797, AI288158, AA426622, AII47684, AI337075, AA307347, AA278932, AA325802, N46726, AA349945, F32975.1, AA426630, R17205, AA317447, R25920, AA573438, I79364, Z45016, AA311984, H63039, AA210832, AI206221, T79795, AI635341.1, AI657051.1, AA100054, AA699967, AA074398, AI051229, AA618039, AA774741, N93074, AA369820, AA494546, AA699823, AA985393, R49286, AA724128, AI624172.1, AI653105.1, AA449934, R02487, AA572774, Z36996, W78826, AA487951, AA699986, AA825221, W58138, AA316671, R99667, AI535689, AI638330.1, R16310, N29041, AA002028, AA099816, AA404344, AI025453, AA766709, R11267, T26409, AA419565, AA997726, AI136610, AI461291, AI437309, AI410864, AI497219, AI168991, AI490343.1, AA660741, AI213288, AI547986, AI172597, M489623.1, AI522826, AI454069, C26539, C26044, AA898979, AA762033, AII12472, AI354022, AI171304, I25171, I08489, A49206.1, I08490, A49208.1, I03259, I32885, I09606, I41388, A22393.1, I11714, I23867, I09479, I23903, A21198.1, I56080, I41390, I23934, I86263

SEQ ID NO: 30

AB003582, Z35663, AP111942.1, U00955, U00930, UI5038, AF072268.1, I22545, X74734, X74733, AF054907, U34609, U27807, D1754.6, L15319, AF076674.1, L16898, Z79604, Z95559, Z79998, U67078, AC004512, J03998, U80440, X87941, D13228, M86518, L33260, AF078157, Z84205, X52482, AC006422, AL008987, Z73018, AL008715, AF063008, S68871, U18985, X98857, AC002107, AB018343, M86602, X12796, Z78545, AE000I35, AC006486, AL031764.1, U32378, Z99107, Z66494, Z81092, AF010465, D13044, Z72672, U23147.1, AF025462, AB007877, X67671, U05593, M74118, M55017, AL031183.4, M59706, D88384, Z93778, J02732, U10925, M25062, Z99753, LA7221, U88622, U19944, AF013962, M21683, U69668, AF080542, AB009080, AF060174, L22568, X81357, M60802, L22567, AF015906, AC002106, I04943, U91339, AE001174, X58692, M261 tO, AA501220, AA413894, AA545071, AI006989, AA414717, AA413931, AA692262, AA124718, AA644787, AA184530, AA414255, AI608097.1, AA254241, AA204345, AI645772.1, AA546413, AA474204, AA537405, AA960184, AI463190, AA154351, AA762263, AI467406, AA415569, AA790480, AA798284, AII18927, AA473696, AA607172, AA097281, AI586114.1, AA008253, C80564, AA793428, AA797955, AA116682, AA123743, AA388279, AA560832, AA103656, AA275567, AU041316, AU014623, AA220725, AI503266, AI550256.1, AI325822, AA220281, AA096809, AA414760, AA798375, AA522310, AA795527, AI427600, AA250667, AA445091, AU015737, AI648759.1, AI098917, AA870830, AI154113, AA120232, AA517672, AA068782, AA107405, C81382, AA215227, AI152456, AA822242, AI158873, W64747, AU015657, AA066952, AII16700, AA123213, C80585, AA607305, AA561640, AA467444, W97542, AA895398, AA880584, AA544265, AA673225, AA109989, D21623, AA118599, AA216996, AI129811, AA573294, AA044623, AA431630, AI125299, AA873150, AI040056, AI088660, AI052744, AI143468, N35166. W79798, AA431345, N35246, AA969145, AI473349.1, AI343799, AI028340, AA707997, W74247, AA491326, AI247482, AA971587, AA837427, AI042280, R15927, AA075430, AA805745, AA621276, AI083576, AA496266, AA043503, AI339495, AI339190, AA767646, AA810773, AI360490, AA836127, N44909, N88182, AA909653, AA132094, AA811534, AA505132, AA490505, AA917728, AA629216, AA634532, AI572897.1, AA953078, T29750, AA912987, AII90735, AA992725, N93741, AI539500.1, AA652541, W25866, AI361041, AA171429, AA913812, AI659798.1, H92306, AA252304, AI669516.1, R55055, T57289, H87389, T56603, R08344, AA027928, AA490867, AI480010.1, AI561169.1, AA496909, AA580606, AI123941, AA576566, AA620502, AA730118, AA372734, AA166900, N91710, AA853296.1, AI374664, P27280.1, P28818.1, Z19557, R39203, W81404, AA181351, AA351039, F25824.1, F22203.1, F32534.1, AI179296, C52472, AA041009, T76660, H76140, AU060597.1, Afl35309, R90523, T22992, C22922, H34426, AI059084, C89964, AA951682, AU039202.1, M485933.1, AI558972.1, AI517768, AU039281.1, Z46697, AI485735.1, C89893, C92481, R47177, AI111998, AU034788.1, AI598324.1, W43801, AI460844, AU053913.1, M331597, AI415981, H31975, D65257, AI058338, C52267, C53848, T44623, C94881, AI145040, AA848373, AU062029.1, AI494986, C55899, C60003, AI621775.1, H34750, C35374, AI586631.1, AI443979, C38600, AU062159.1, AI486280.1, AA925172, C54298, AA943835, AII71577, AI170908, Z24524, H32221, AI099554, AI437879, T41463, AA858936, AI440561, Z30478, AII00451, AI494816, AU060757.1, C27777, C31220, C34754, C56603, AA891555, C90006, AI021789, AU029338, AU002236, AA394554, N96614, M055261, AII64717, AI437064, C25656.1, AI011951, AJ514017, AII76695, AU053195.1AI4885111M410617 AI496384, AI641373.1, AU065381.1, AU029500.1, I51044, RI1689, E01609, E01608, A00764.1, I92772, I90008, I43820, E02462, A38811.1, I69387, E13315, I33396, A20359.1, I70401, AR002611, E04896, I70400, E08230, I56651, I86194, I17189, A59616.1, I17185, I13521, I13520, I52048, I82816, I85817, I85812, A36718.1, I33400

SEQ ID NO: 31

AB003582, AF016425, U91328, U35641, AL021879.3, U68174, U32446, U31625, U36475, AL009047.1, AF043695, L15188, M96150, AC002493, U61953, U63926, Z70751, L15314, U27083, AF039719, L14429, X54061, Z73907, AI606472.1, AV026932.1, AA461916, AA254428, AA139085, D77591, AA840125, AI666765.1, AI606628.1, AA919797, AA739471, AI642108.1, AA200862, AI647641.1, AA170629, AA592191, AII17556, AI607952.1, AA125128, AA204572, AI645907.1, AI173969, AA261.111, AA616368, AA177474, AI132359, AA636166, AI591537.1, AI426332, AI226253, AA287999, R62682, AI453362.1, AI264590, AA831544, AI354355, AA466074, AA021049, RI 5926, AI261510, AA132007, AA644663, AI473492.1, T90054, R62629, AA075381, AA491322, AA450151, AA531040, AA992324, AI434681.1, AI571046.1, AI248612, AI650613.1, AA283604, AA101106, AA398112, AA363221, P23255.1, AI408748, AA945774, AI233193, AI598788.1, M406920, AI058858, AA800914, AI012637, AII77634, AI502828, AI676929.1, AA874839, C07240, AA859628, AII75753, AII04374, AI233631, AA924122, AA925465, AI455329, AI549032, AI548826, AI657631.1, AI549031, AI437396, AI8079.1, AR022169, I55948, I59684, I69352, AI7115.1, A67425.1, I56872, A51688.1, AR022373, AR022395, I12874, A01796.1, AR012052, E06949

TABLE 1-continued

Sequence homologies (GenBank Accession Numbers)

SEQ ID NO: 32

D49817, AF056320, D87245, D87243, D87247, D87244, S77845, D87241, D87240, D87246, D87242, AB006710,
AF041831, AF041827, AF041830, AF041828, AF041826, AB012229, AF041824, D49818, S54076, AF041825, M19938,
M64797, AF041823, U15177, AP110958.1, U84724, Y00702, X15579, X15580, M15685, J04197, M64323, S55569,
AF041829, M34241, S70453, D25222, D25223, AJ005577, S67900, L27084, AL020991, Z83821, AJ005578, X61956,
X98848, X98847, X74563, X65958, U41558, L13738, AL022023.1, AF049895, AF124929.1, AF070717, AC004083,
AJ131213, L81766, X53095, AC002194, M11794, AU036054, AI037207, AI644411.1, AI326331, AI265388, AI021341,
AI035957, AI663904.1, AI386013, AI529513, AA104899, AA107038, AA959269, AA259918, W15760, AA109028,
AA397024, AI048602, AI5295t2, AA038178, AA212882, AI528961, AI596603.1, AA606776, AU021029, AI006670,
AI117478, AA276983, AA690507, W66728, W08311, AA008094, AA008587, AA498148, AA672158, AA692875,
AI156797, AA238526, AA692754, AI047517, W17450, AA238155, AA498485, AA592576, AI155978, AA839409,
W47800, AA002271, AA212331, AA760244, AA241761, AA882063, AI42526t, AA086590, AA088999, AA450585,
AA764288, AA387250, W82750, AA276319, AA245963, AA155308, AI117500, AA637835, AA002885, AA064210,
AI604392.1, AA463459, AI262563, N23313, AA282463, AA281981, T03795, Z24787, AI572739.1, AI473585.1,
AA732066, AA807070, AA324504, N32473, H47404, W27604, T62734, T62884, AA994528, AI401563, C23067, C23192,
AI389739, AI513846, AI062079, AA997994, AI354213, AI547848, AA859449, N60127, AI232706, AI011564, U31295,
C23488, C23498, AA041104, AI327728, C23512, C73020, C23516, C23487, AI044877, H35624, C23515, AA819697,
AA941531, C23517, AI071154, AI398096, AI065761, AI637202.1, C10324, AA945153, A01474.1, A01475.1, I22481,
I22486, I41428, E02337, I01637, I62306, I82495, I30970, I96177, A39603.1, I15826, A09811.1

SEQ ID NO: 33

D49817, AF056320, AF041830, D87244, D87247, D87243, D87245, D87242, D87241, D87240, D87246, AF085891,
AC004028, AC004761, AC005027.2, AC004448, AL008731, AF017104, AC006958, AC004673, AL008635, AC004927,
AC004711, AL035408.5, AC004024, AC005384, U82671, AC006040, AC004674, AC004001, AC002076, AC002078,
AL049633.3, AF067846, AC005284, AC006566, AL022165, Z93931, AL035671.5, AC004617, Z92542.2, AL033524.11,
AL031733.3, AC005195, AC004903, AC005365, AC004067, AC003082, AL049565.3, AC002551, AC003991, AC006101,
AC002300, AF110324, AC006368.2, AC006121, AC004540, AL023284, AC006926, AC003953, AC006377.3, AC000087,
AL009172, AC005279, AL034349.3, AF001549, AC000068, AC004990, AE000659, AC005007, AC004112, AC004508,
AC005695, AC007001.2, AC003983, AC004856, AC005221, AL033504.3, Z22800, Z93942, AP000119.1, AC004010,
X86012, AF047825, AC005510, AC000060, AC003666, Z93242, AC005833, AC002461, Z95328, AC004552,
AC004384, AP000132.1, AC002287, AC005865, M95623, AC002394, AI644411.1, AI326331, AU036054, AA771586,
AA208227, AA763145, AU035549, AA763350, AA553083, AA237248, AA624850, AI607557.1, AA798390, AA537660,
AA173020, AI530357, AI120704, AA289308, W53048, AA709792, W14745, AI047878, AA250177, AI182329,
AI674428.1, AA635720, W78940, AI078168, AI076629, AA069247, AA020850, AA551369, AI350338,
AI363842, AI299777, AA931284, AI038776, AI373775, AI373258, AI470966.1, AA482147, AI224486, AI497836.1,
AA885520, AA204774, T03614, AA425126, AA424313, AA564120, T91869, AA722427, AI168785, AI539477.1,
AA962537, AA847073, AI093937, AA728963, AI281197, AA233305, AA460258, AI246337, AI343255, T41024,
AA557606, AA128913, N55081, F06102, F11152, R91132, H49193, T87273, AA621428, AA004635, R15347, H13351,
N28811, N46199, AA171692, AA262227, AA628310, AI205827, AA127255, AA521374, AA625602, AI123137,
AI055852, AA255634, W88780, T62743, W00726, AA994528, T64240, T68129, W05737, AI401563, AA243683, T67567,
T68815, I71759, AA181575, I73160, R98312, D20281, AI282122, T61423, T68145, I73547, I74632, I73693, H97381,
AA481133, AA676631, AA700882, R98068, AA862511, I73271, N24799, R15209, AA243708, AI384053, D39547,
D39557, AI008547, C26609, M512288, AI512289, A51135.1, I22486, I22481, I91983, I22785, I66262, E02657, I91769,
E03391, E00418, A64588.1, E03392, A00200.1

SEQ ID NO: 34

U01139, AF119164.1, AL031597.7, AC004245, AC007178.4, AC002366, X06908, AL049488.1, M64277, Z47073,
X67813, X66218, AL031229, Y10983, X67050, X84996, U67551, AE001379, AF131775, AA444450, AA413633,
AA032944, AA011740, AA170933, AA445063, AI019160, AA855757, AA174904, AA106259, AA518999, AI272577,
AA947691, AA765947, AI525873, AA780448, N88951, AI292015, AA442405, H91985, AI431847.1, AA769068,
AA494443, AA810758, AI318348, AA633743, AI084487, AI352528, H20802, AA578819, W24964, AA193125,
AI631593.1, AI127110, AI218706, AI631812.1, AI611150.1, M379177, AA630879, AA503096, AA418466, AA263132,
AA853480.1, AA767083, AA866195, AI203275, AI214077, AA677435, AA596024, AA195476, D59397, AI270536,
AA992457, AA173591, AI240783, AA765257, AA722220, AI352414, R85498, C60926, C44543, C92581, AA536569,
AI549005, AI577194.1, C84039.1, AI179999, AI179624, C90803, AI547577, AU034720.1, C93873, AI1794.60,
AA957340, C90627, AI599186.1, C89893, AI575384.1, AI485055.1, I52101, AI2146.1, AI2755.1, E03879, A41497.1,
I62710, AR022306, I23762, I34456, E04373, I64526, AR008485, AR008474, AR008473, I34457, E02497, A45919.1,
I34458, I34459, E02220, I07977, AR001606, AR008472, I23460, A24287.1, I83401, I83400

SEQ ID NO: 35

U01139, AL031684.11, X05914, D37887, U33449, AC002404, Z48755, AC006248, L35107, AB018114, U33450,
U67557, AL023095, AF106592, M11327, AC005037.2, AE001438, L16560, AC002540, AL031073, AC005876, Z68333,
X61239, MI 7513, AI023281, AC000106, Z98043, U77854, AC002447, Z75746, AB026652.1, Z81032, AU045794,
AA855253, AA178644, AA213292, AA231343, AI664137.1, AA413114, AA168370, AU045797, AU042463, AA445063,
AA174904, AA409225, AU015733, AV027798.1, W98292, AA414727, AA103769, AI006231, AI139364, AU 18678,
AI096332, AI458051, AA046520, AA022892, AA827111, AA993891, AI188281, M311005, AA453435, AI362529,
AI459074.1, AA046631, C16029, AA765947, M525873, AA995762, AA987421, AA853997, AI650849.1, F31785.1,
N79896, AA226443, F35756.1, AA226590, AI186189, AA203258, AI561123.1, W58557, AA047437, AA875842,
AA931554, AA977805, M095753, AI377507, R49007, AA424553, AA709042, AA931462, AA348260, AI023483,
AI167302, AI347736, AI366727, AI476255.1, R78745, AA343527, N30348, H12792, AI655467.1, R82272, AA917907,
AI090219, H03958, AA973755, AI093579, AA772695, M128281, N48863, AA581573, AA698978, AA149648,
AI609942.1, AA194969, AA009861, AA236889, AI022130, AA782106, T25462, AI084529, AA888853, N92587, R76998,
AI221007, AI362557, AI285412, AI274861, AI264779, AI309998, AI636254.1, AA962495, AI334147, AA706222,
AA482724, N75832, AI421045.1, AI349116, AI376079, AI372898, AA587812, AI147618, M096659, AI176212,
AA801413, AA891042, AI029315, AA998967, AI232767, AI484819.1, AA116210, N98132, M75842, U38033, AI059570,
AI059076, AU060339.1, T44877, E01546, A51764.1, AI5353.1, AI5354.1, I32307, E00038, A58934.1, I14046, A06133.1,

TABLE 1-continued

Sequence homologies (GenBank Accession Numbers)

A06129.1, I14048, I17504, I14051, I14050, A08891.1, A23184.1, I14047, AR009805, I12361, AI2418.1, A06131.1,
I17503, A23158.1, A21622.1, I00848, I13767, E07175, A58933.1, A58932.1, A23159.1, I14049, I17500
SEQ ID NO: 36

AC006193.3, U63409, Z81121, U39574, AC002044, AB026644.1, U23443, U49953, AF082077, AB016885, AC007175.1,
AF053725, Z95395, U84890, Z72006, AA245703, W64239, AI510622, AA763740, AA589807, AV043247.2, AA250407,
AI585450.1, AA522344, AA118067, AI325769, AA276124, AM 10650, AA276084, AA106797, AA530618, AI368109,
AI657030.1, AA077662, W30989, W26365, AA076765, AA078297, AI439623.1, T43611, AI563387.1, AI211256,
AA966240, AA787771, AA787988, AA785273, AI210879, AI209729, AA391392, AA785333, AI211707, AI212122,
AI212031, AA783382, AA783723, AA788070, M514749, AA786098, AA787897, AA787097, AI327553, AI213060,
AI211989, M211043, AI209715, AA966743, AA785789, AA785589, AA784785, AI515323, AI327704, AI213794,
AI212902, AA942425, AA788189, AA786118, AA785358, AA786912, AI209610, AA788069, AI327959, AA785782,
AA783934, AA783397, AI212656, AI209470, AA783714, AA202831, AI212353, AI210214, AA966079, AA898672,
AA788035, AA785332, AA390378, AI667826.1, AA966181, AI327971, AI327961, AI213686, AI211682,
AA949438, AA787772, AA786394, AA783629, AA783603, AA966756, D34814, C69484, AI438077, AI483915.1,
AI043537, AI626724.1, AI495163, AI486398.1, AI487689.1, M494701, AI442677, AI1189.1, AI1190.1, I14360,
AR002552, I42103, I14357, A48542.1, I14358, AR020969, AR009920, E01979, E02627, E00987, I21869, E03528,
I27091, I19994, AI2297.1, I44702, I44700, I44701, I44520, A65720.1, AI2522.1, AR016569, AR016568, AR019675,
I04549, AR016503, E02629
SEQ ID NO: 37

Z92540, AC005505, D11328, AC005609, AC005159, Z99753, AC005772, Z54306, Z14314, U64842, AC000026,
AF016420, AC004785, X98745, Y07848, AP000109.1, X96869, AC005389, AL034563, U14010, M76741, AF034779,
AC004170, AC002059.3, M86723, AL033503, Z70682, AL031003, AC002367, Z54142.1, M86709, AF029683,
AC005368, M21635, Z83240, U25440, D26137, S69790, AB020707, X89391, AC004805, AL031543, Z84470,
AC006501, AC005688, AL035555.10, U70852, U07366, AC006157, AC004385, AF037261, AI415391, AA989738,
AA623446, AA590109, AI035339, AA103137, AI325124, AV044985.2, AI427784, AI197082, AI561916.1, AV036459.1,
AV037551.1, AA390051, AV034318.1, AV035393.1, AA986430, AI157519, AI116208, AU041091, AA014905, C80228,
AI060827, AA345854, R77044, AA662655, AI625045.1, AI570383.1, AI242456, AI469086.1, AA905873, AI274581,
AA400052, M143501, AA974367, AI381657.1, AA678138, AA676551, AI400147.1, R49939, R49938, AI648386.1,
AI393926.1, R76882, AI631973.1, AI304908, M081062, AI299091, N66118, N55016, AA664404, AA831586,
AI635187.1, AA010487, AA339940, AA504924, AI185951, AI332301, AA364258, W81092, AI351464, T34677, H82089,
AA632333, AI092180, N83590, T98503, AI044549, AI012163, AI484234.1, AI482974.1, AI484230.1, AU003377,
AI482971.1, AI482990.1, AI575701.1, M555543.1, AI179431, M101527, T09816, AA186314, T26171, AI169299,
AI228530, AI602993.1, C91208, AI045636, AI532848, AI584880.1, AI066222, AA851746, AA866503, AA550607,
AA739567, AI066285, AA140614, AI236395, AI171094, AA011988.1, AI407713, AI559074.1, AI110508, W00177,
AI257843, AI658114.1, AR012053, I25986, A56787.1, I15087, I84552, E03690, E03687, I87840
SEQ ID NO: 38

AC005747, M74161, AB026644.1, Y08257, Z29522, AL049813.1, Z33620, AF049617, U26707, AF002817, AF023661,
AB006458, AA245703, W64239, AI006615, AI036502, AA597087, AI429010, AI605500.1, AU051532, AI121505,
AA197709, AA543707, AA673804, AI323520, W36675, AA475816, AI666529.1, AI505997, W88229, AI368109,
M657030.1, W30989, AA077662, W26365, AA076765, AA078297, T63274, M515323, AI514749, C96225.1, AA390378,
AA140598, AA942425, AA202831, AI213553, C72876, AA695184, AI487689.1, M532028, AI486398.1, AI212540,
AI210410, C69484, AI483915.1, AI031452, I41422, I62858, I09215, A65264.1, I28467, I28466, I42103, I28448, I41330,
I05094, I05091, I09216
SEQ ID NO: 39

AB011478, AF037261, AP000I20.1, AL022101, AA989738, AI415391, AA623446, AI035339, AA986430, AV015789.1,
AA390051, AA178458, C76229, AA186181, AI553055.1, AA345854, AI274581, AA662655, AA905873, AA400052,
AI469086.1, AI242456, AI570383.1, AI625045.1, AI143501, AA974367, AI381657.1, AA678138, AA676551, R49939,
AI400147.1, AI393926.1, AI648386.1, R77044, R76882, R49938, AI216687, W22215, AA088921, AI044549, AU031505,
AA817766, AI8521.1, E01304, I85620
SEQ ID NO: 40

AF070523, AC004787, AL034404, AL031716.8, L35663, AF032455, AC004675, I25664, AC005612, AC00Z116,
Z25749, AF038458, AL049171.1, AC006392, AC000100.2, AC004976, M59317, U28929, AF088219, X98833.1, U63834,
I25131, AP000099.1, AA222765, W59671, AA097900, AI182252, W11401, AA051031, AA797610, AA710408,
AA967556, AA717935, AA560200, AA794040, AA871635, AA871678, AA154429, AI661797.1, AI425453, W29555,
AU035139, AU035393, AA714791, AI570372.1, AA071179, N92494, W02193, AA928916, W58390, W52978,
AA192376, AA278398, AA083615, T86811, AA578003, AA608786, AI077911, AA092532, AI434484.1, H03590,
H44243, N88629, H25977, AI057310, AA769743, R82460, AI478505.1, AA569765, AI270619, AA248471, W24795,
N44506, AA093674, R83437, R83429, AA009662, AA036868, AI146476, W16602, AA143582, H78436, M052425,
AI630062.1, N74004, R39633, H00365, T93191, AA297213, AA080889, AA249377, AA309028, AA009661, T97284,
M523284, AA095247, AA084246, AA430087, C05938, c03461, N34780, D80224, D59738, D59803, C14373, R78724,
C17464, AA263026, R59236, Z44435, R17802, AI129173, H05235, AI142543, AI461526, AI665972.1, AA699075,
AI395704, AI061987, AI395269, AI395400, I96198, AI6257.1, I88862, AI6258.1
SEQ ID NO: 41

AF056359, AL023773.1, AB002389, AC007156.2, AA821342, AA198254, AI286749, AA870126, AI663673.1,
AA596129, AA038523, AA870705, AI591664.1, T59268, AA299257, AA657729, AA852211.1, AI609700.1, W65400,
D31528, D31541, AA319726, AA382381, AA382234, AA364833, AA622501, AI538117.1, AI652363.1, D25665,
AA133232, T36186, AA436115, AA135673, AA884806, N91600, AI264327, AA128760, AA129755, AI093292,
AA232960, AA468604, AI417825.1, AA621574, R70347, R92801, N54406, AA262674, AA352981, T70171, AA622098,
AI318565, AA861212, H 16602, AI354454, H00752, AA628732, AI267232, AI267384, AI078745, AI474673.1, W69399,
AA314050, AA489344, AI185884, C82724.1, C83580.1, AA438381, AU060005.1, AI210138, AU058483.1, AA390900,
AI211858, F14598, AI386714, AA783848, AU060017.1, AI210129, AR020615, I76208, I06168, I01006, I17185, I17730,

TABLE 1-continued

Sequence homologies (GenBank Accession Numbers)

E07665, I89854, I89856, I17735, I17189, E07666, I14051, AI4707.1, A51201.1, I16614, I58527, I58538, I75051, I23847, I14047, AI4931.1, I14048, I14049, I18351, I14050
SEQ ID NO: 42

AC005844.7, AL031622, AC002123, Z82193, AL031133, AC005969, AC002365, AL031643.1, AL031584, AC006487, AP000072.1, AC003088, AL021997, Z82194, AC006464.3, AC005201, AC006142, AL021408, AC003684, AC004939, AC005189, AC006972.2, AC006384, AC004764, AC004802, U82694, AF074021.1, AC005392, AF036876, U49973, A0000025, AC005527.3, AC003010, AC005537.2, AC005228, AC006481.3, Z74032, AF016451, AC005186, Z99297.1, Z97992, AE001390, AJ224476.1, AC006471, AE001115, AF008218, U67544, AL034402.9, AC003701, Z92547, AL032623, AL022726, D16236, AC004910, AC005213, AC004594, AC000003, AC002485, AE000786, Z98547.1, Z82604, AC005188, U90093, X15388, X87622, X51344, AC005554, AE001389, AC005864, AL023694, Z78060, AC006539, AC005587, AF049132, AA274173, AA517527, AI082183, AA662437, AA024662, AA994712, AA382233, AA382380, AI494136, AI478176.1, N72023, AA834895, AA961977, AA828992, AA559210, AA459825, AA609919, N62213, T91094, H60040, T91239, AA769203, H67137, AA887286, AA808252, AA884090, AA830916, AA287337, AA877615, AA281449, AI587210.1, AA593295, AI609700.1, AA421744, AA452801, AA634323, AA971651, AI090486, AI289082, AA024968, AI272646, AA426303, AI148235, AI221431, AA258397, AI271647, AI435922.1, AA709039, AA419609, AA978105, AI092202, AA781428, AI039122, AI382511.1, AI052573, AA600736, AI391581, AA834031, W70308, N54488, AI364175, AA805775, AI350380, AA478719, AI691942, AA410897, AA455497, AA456579, AI270416, AI218226, AA084698, M204305, AA774270, AA489209, AA446024, N67061, AI673545.1, AI628019.1, AI432010.1, AA999606, C83459.1, AA550297, C82603.1, AA495017, AI622048.1, AI622047.1, AI556272.1, AI533930, AI544972, AI667753.1, AR020615, A39382.1, A28439.1, I57013, A01560.1, A36402.1, I06721, AI2527.1, I90201, A52254.1, A52140.1, I70103, I08800, I20815, I90191, A01561.1, AI4133.1, I01908, AR022664, E05720, A40105.1, A00221.1, AR022642, A48436.1, AI6254.1, A70894.1, E05716, E05723, A08893.1, A40106.1, A00219.1, I09307, A27642.1, I24773, AR022657, E03525, A08911.1, E02313, E05721, E08855, I86831, A40099.1, A70873.1, I12551, A40102.1, A31099.1, E05722, E05206, A40100.1, AI6255.1, A40096.1, A56786.1, I61427
SEQ ID NO: 43

AF064861, Z98247, X52708, D63663, L46865, M76678, AJ001341, AF027735, I26049, Z98271, Z77662, Y0891.1, AL030994.1, U89914, AF092051, AF058825, AC007192.1, AF082299, S74439, I22208, Z97341, U64904, AF027737, AC004293, AA185658, AI645233.1, AA041959, AA733559, AA879514, AA462293, AA183470, AA521582, AA791930, AU019949, AA560934, AA238848, AI155747, C76303, AA569338, AA794642, AI173441, AA000607, AA794660, AU046264, AA269393, AA051685, AI316068, AU045218, AI173590, C88259, AA986532, AU014886, AA726301, AA291276, Z43080, T30919, AA484992, T16876, AA247778, AI377710.1, AA210994, AI276200, AA610142, AA079333, AA852394.1, AA079283, AI683364.1, AA826038, AA629629, AI356399, AA642452, AA234289, AI337264, AI417421.1, AF072813, AA769905, AI660570.1, AI392942.1, AI102997, AI071631, AI385307, AI502515, C27657, H56817, AA753205, AU062947.1, D40685, T88181, AI259374, AU064324.1, AI239376, AA246373, D49248, D48506, D39349, D48938, D49206, D40580, C20345, D23884, T42841, H76194, Z25517, AI109065, C74478, AU030128, C72915, AI667210.1, C70622, C74396, C28108, C68647, AI670304.1, C74891, C99603, C25894, AU059908.1, AU057738.1, C73243, C74094, I95876, I95881, I95878, I95879, E02722, I21323, E05293, E02081, I90008, A43647.1, A43649.1, A58329.1, A43645.1, A41272.1, AR001253, A27636.1, E12560, A06406.1, E02194, AR001494, AR001500, I16741, AR001502, I95887, E02465, E02199, AR001505, I24739, A06404.1, AI0241.1, A68584.1, I95882, A46715.1
SEQ ID NO: 44

U43293, AC002383, AC002128, AB007935, D12514, AC006462.2, AL022313, M24078, U37528, AA870210, AA596277, AI153677, AA197769, W10331, AI131925, AA655736, AA986419, AA122665, AA561670, AI118316, AI663564.1, AA543641, AV047177.2, AA423215, AI195113, AA518547, AI647567.1, M196401, AA475667, W08414, AA821530, AA404028, AI644946.1, AA162825, AA434914, AA959031, AA948591, AI220168, AA918556, AA904905, AI004650, AA909293, AA651874, AI040052, AI052643, AI521897.1, AA315914, AA846024, AI276133, AI452563.1, AA732326, AI521221.1, AI143397, R25586, N63758, AA083158, AI580354.1, R66081, AI572855.1, R67802, AA113057, AI332453, AI627623.1, AA252152, AA535874, H92882, AI633935.1, AI465181, AI263137, AI636673.1, AI634875.1, AI375906, AA682627, AA492206, AI582606.1, AI435606.1, AI146340, AA251967, R33612, AI236097, AI180153, AA417470, AA417471, I24453, I24438, E03790, I24437, I04770, I16670, I16683, I89423, E02137
SEQ ID NO: 45

U47110, X97854, AC004098, D87924, Z49126, AF051353, U40656, U17352, Y17138, M26651, U46893, AF083072, J02974, X98131, Y17137, AI529368, AI593118.1, AA241904, AI425479, AA536990, AA414342, AA030172, AI049408, AA637184, AA240607, AA014933, AI154799, AA016933, AA041697, AI091298, AI375098, AI660316.1, AI435931.1, AI524203, AI571317.1 AI659324.1, AI418486.1, AI094880, AI675241.1, AI560264.1, AI224948, AI672681.1, AI084171, AI423636.1, AI276183, AI246175, AI264589, AA835659, AI341540, AA410348, AA215710, AA258475, AA315745, AA764863, AI264852, AI143673, AI304322, AA543059, AA813462, H98014, AA551682, AA406408, AI312786, AA262869, AA215709, AA523975, AA479232, H98842, AI004617, AI498511, N56734, AI361640, AI515115, AI263455, AI516010, AA735642, AI519144, AA567492, AI114087, AI296577, AI236341, AI388216, AI576548.1, AI598367.1, AA042605, C93558, AI059885, AI071918, A70054.1, A70052.1, A38684.1, I16615, I84465, I17755, I72654, I17524, I17756, I17758, E12746, A69563.1, A45258.1, I17525, I72653, I34034, I12220
SEQ ID NO: 46

AF086317, AJ235273, Y11778, AF042090, AL031387.4, U43322, AC006123, U43325, M21276, AC005169, M38595, U58750, AL021451, Z98751, AC005844.7, AL034377.1, S82691, AC004226, Z82058, AF100663, AC006213, Z99280, L19443, Z68116, AL031846, Y13408, AC004023, U29097, AC004926, AC002045, AF098504, AC004692, AC005398, Z80214, M18288, AI006304, AA096886, AA197701, AA013950, AA276858, AA608195, AA761971, AI674814.1, AA204693, AA465292, AA262434, W73354, AA767616, W73333, AA252525, AA648818, AI075941, AA187979, W65369, AI241748, H08500, AA872830, N33227, AA322188, AI215037, AI673146.1, I29502, H90761, AA013315, AI289818, R23687, AA564134, AI631235.1, AA351162, AA375063, AA083483, AA164999, AA507980, AI608803.1, AI085057, AI190190, H17159, D25257, AI278718, Z43956, N54983, AA075700, AI670855.1, AA313445, AI628506.1, AA969719, AA228015, AA058718, AA258291, AI365170, AI269300, AA962727, AA131517, AA057273, AI672085.1, AU061565.1, T42574, AI629069.1, N97751, AA786148, AI069512, I07691, E03171, A51422.1, E03667, I07373, E04428, AI6121.1, A62786.1, I38435, E03670, A28743.1, I08188, A70354.1

TABLE 1-continued

Sequence homologies (GenBank Accession Numbers)

SEQ ID NO: 47

AF086317, AF067606, AF125457, AL031387.4, X98739, AC005169, S82691, U43322, U43325, Z98751, X98738,
AL021451, AC004883, U29097, AC004692, AF064858, AF091592.1, AF064859, Z81592, AC004070, Z82058,
AA276538, AA013950, AA197701, AI428348, AA276858, AA162670, AA013949, AA096886, AI006304, AI551996.1,
AA608195, AA204.693, AA262434, W73354, W73333, AA252525, AI075941, AA761971, AA648818, W65369,
AA453653, AI674814.1, AA465292, AI374660, AA908731, AA831594, AA281080, AI147200, AA766128, AA187979,
AA749119, AA767616, AA258291, Z43956, AA889787, AI193232, AA058718, AA322188, AA824347, H90761,
AA164999, AA868962, H17159, AI640190.1, AA313445, AA375063, AA057273, AI221093, R16835, AI365170, R23687,
AI190895, H72054, AA851479, T42574, AI629069.1, AA786148, L22260, I22445, A28743.1, I11616, E05381, E03629,
I23429, I23419, I23414, I15119, A22127.1, A48775.1, I22443, E04428, I23420, I22432, I23417, I08786, I49034, E02167,
A37270.1, I08787, I91962, A58904.1, A48782.1, A48779.1, A48776.1, I23421, I23418, I23416, I11617, A00076.1,
A00077.1, I23431, I23415, I11619, I11618, I08011

SEQ ID NO: 48

AL049280.1, L15344, U46844, AC004015, AF073775.1, AC004991, I341103, X98718, AC005701, Y07866, AC005751,
AF043084, Z81542, AA914306, AA386630, AA529628, AA386499, AV011861.1, AV034904.1, AA472991, AI607039.1,
AI573543.1, AA279010, AI654057.1, N24002, W51873, AA252518, AI129169, AA642399, AI478789.1, AA252353,
AA806034, AI494462, AA721744, AA805516, AI470516.1, AA515852, W48659, R43924, AA534309, AA190645,
AA761615, AA585431, AI656638.1, W52095, W52847, AI478711.1, AA155623, AA316968, F11933, H52265, AI003490,
AA181169, AA938438, AI041968, D56120, AA376800, AA343532, AA112761, AA345840, AA301631, AI051622,
AA448849, AI220485, W94856, AA113786, H80982, W25540, AA292949, AA083489, R21214, AA308636, W67221,
T97663, AA347236, AI358757, AA789079, AA315188, AA180483, AA088544, AA687534, AI655468.1, F31587.1,
AA664304, D58990, W39480, AA190873, F00242, AA343799, AA425253, N47475, C06300, AA554136, AA687217,
AA098791, T66110, T61714, AA490997, AA488005, AA376086, I92525, N57402, AI652094.1, AA806389, AA452515,
AI545400, AI512953, AI294286, AI296583, AA696925, AI294441, AI297495, AI513015, T01466, AA820982, AA750686,
AJ234148, AI406511, C82888.1, C83744.1, I34297, E12511, I21438, I21437, I21436, A58240.1, E06596, I28845,
A27529.1, I38760, A62217.1, A39962.1, E08680, I44066, A39598.1, A44511.1, A58393.1, E03156, E02262, E01185,
I86264, A58395.1, I11609, AR022361, E06597

SEQ ID NO: 49

L29059, D26018, AF060713, AL049481.1, AL049487.1, AC007110.3, AB008269, AC005324, AC005957, AL035678.1,
AF067624, AL049751.1, AE001277, AU019923, AA790764, AA289012, AA274649, AA432829, AI153815, AI675365.1,
AI367369, AA812199, AA130591, AI276671, AA088262, AA576986, M554885.1, W67375, AA833632, C05699,
H15177, AA496347, AA731379, AA371430, N92996, AA761272, AA730235, AA995351, AI570582.1, W73779,
AA747918, AA805606, AA748462, AA262803, AA832453, AA278685, AA481121, AI380252.1, AA595943, W03789,
AA918362, K54023, AA244344, AI175594, AI045299, AI545940, T45626, AI497428, AI497059, AA550002, AI443954,
AI109977, AA549994, I22796, A46440.1, I75061, I22798, L22787, A65999.1, I31747, I89451

SEQ ID NO: 50

X71988, AF092977, M36470, AF092986, AB025641.1, AF045450, AB019440.1, AB019438.1, AF017739, AL008628,
AF121782, X87148, I27948, U10399, AC007125.1, AF117069.1, Z94277, AF117095.1, U82320, AP117101.1, W10466,
AA097281, AV045817.2, AA182214, AA182285, AA244534, AA692973, AA711787, AI616238.1, AA509995,
AA510108, W09442, AA210327, AA028342, AV044118.2, AA107935, AI475809.1, AA953569, AA757586, AA357776,
AA777916, H30593, H26221, C84167, T41462, AI103270, AA697485, AI055470, AI437508, AA956292, T45723,
AA055521, E06829, AR007118, I19367, A61529.1

SEQ ID NO: 51

AB025254.1, AL021713, 867476, AC002365, AF025462, AC003084, X52576, AB003151, AL035671.5, Z82203,
X17072, M63176, L13028, AA125100, AA940381, AA474962, AA823551, AA796018, AI592091.1, AI042863,
AI182307, AI042852, L26676, W52937, AA581819, AA053405, AI131436, W60448, N20536, AI367494, H20536,
T52694, H84947, R39606, F10986, Z40529, F04085, AA384013, N29241, W78744, AI084738, AA766263, H50660,
N88923, AI131238, AA906294, AI241748, AA642396, AA630797, AI094387, AA850501, AI22815, AI145641,
AI502281, AI555714.1, U83075, AI329948, D49194, AI545469, AA848626, I49914, AR000019, 938891, AR000018,
I41428, E02040, A44436.1, A21365.1, I47707, A21373.1

SEQ ID NO: 52

AC006501, U52364, D30733, X82777, L11172, AC005184, AL050089.1, AC004288, AC006265, AB025631.1, U15660,
U20796, AF030104, X78135, D85391, D13160, AA914458, AI120766, AI597366.1, AA106588, AA982134, AI255504,
AA222292, AI195443, AI132235, AI255753, AA717690, AI118602, AA558698, AA824102, AI265415, AI286961,
AI529838, AA019963, AA015589, AL049006.1, H96143, AA558698, AA937328, AI471939.1, AA973792, AI473655.1
AA941141, AI401995, AI461604, AA649389, AA752733, AU002004, AA649390, AI438910, I02561, I18303, A43598.1,
A63129.1, I26124, I95674, I68291, I07427, E02076, I95673, I76961, E05467, I32308, I68298

SEQ ID NO: 53

AC006501, Z47795, U45241, D55677, AC006083, AF016436, AC004259, L26506, AC004600, Z98598.1, AF125443,
U39364, AB009809, X91981, AF047663, L15387, X17548, AC005224, Z98551.1, Z49627, AC004613, AC002069,
Z69724, AC007188.5, AA124618, AA184293, AI644134.1, AA20036, AA759554, AI131939, C79862, AI156921,
AV029755.1, AA968147, C79876, AA526221, AI015849, AA058613, AA576477, AI453080.1, W74118, AI299960,
R78207, AI150210, AA868829, AA424041, AA013272, AA036751, N53365, AA740889, AA019923, AI376273,
AI038661, T40212, N55912, AI554328.1, T41078, R27284, AI174640, AA057323, AA502684, AA249700, H86444,
AA053317, AA504997, H23232, R63602, T10181, AI635849.1, AA563853, R17137, H52920, AA332512, H90598,
AA026241, AA151159, AA600215, AI470215.1, AA098889, AA152020, AA723684, D11524, AA102812, AA148370,
AI151435, W01199, AA128088, R32524, AA151499, AI091627, R32531, AA151495, AA933903, R81994, H03550,
AA035074, AI128347, W86156, N92061, AI287259, AI071296, AA848853, AI012051, AI227883, AI058556, AI087481,
AI087560, AI562409.1, N97829, AI137600, AU063472.1, D73289, C91346, D71610, AA142289, C11551, AA550104,
AI402555, AU038875.1, D72656, C07626, AA698344, C28874, AA550157, AI293798, AI260863, C24185, AA735416,

TABLE 1-continued

Sequence homologies (GenBank Accession Numbers)

D72962, AA739987, AA390223, AA550096, I92820, E12157, I09512, I08921, I08774, I08777, I08920, I08775, I82521,
A43598.1, E01662, I08922, AR007445, E02799, I40109, A59607.1, E05042, I44518, A14705.1, A03736.1, I56735,
A59616.1, I56746, A22651.1, I25170, A59593.1, A43592.1, AR007448, I56733, I44733, AR007444, I31802, I46883,
A29820.1, I75067, I60253
SEQ ID NO: 54

X79560, AB006706, Z99774, AA571188, AA754667, AA874361, AI316772, AI098617, AI557700.1, AA160815,
AA171879, AA159122, T31548, H23167, AA172145, H12990, AA074618, AA156185, AA868567, W02906, AA082540,
AA236289, AA641033, AI160819, AI160959, AA864664, AI590976.1, W92296, W79177, N75177, N75140, C01022, AA897694,
N52369, AI064198, AA439935, AR012159, I64540, I22489, AR006845, I38875, I28953, A62217.1, E12108, E00135
SEQ ID NO: 55

U36476, AC004602, AP000124.1, S67830, X72794, U2441, D12712, Z27231, X72795, Z92544, Z82202, AC004080,
AF006043, M60806, AA472520, AI413588, AI481916, AI390125, AI158454, W17685, W09056, AI594821.1,
AI180813, AA606770, AI014673, AA171939, AI083920, AI096399, AA579859, AI678769.1, AA837461, AI494245,
AA614760, AA845317, AA176164, AI356496, AA984500, C20767, AA171551, AA953092, AI652026.1, AI653702.1,
AI453299.1, R43419, AA768725, AI040243, H05631, AA161220, F32286.1, AA039678, W67653, AI161215, AI681159.1,
H45266, AA777659, W68153, AI355285, AA576289, W63787, AA310115, AI460065, AA216052, AA459339, AA083801,
AA182585, AA745703, AJ003351, AI200598, AA024594, AI433956.1, W05293, C73666, AI392054, AA739943,
AI029769, AI070854, AA955662, E04563, A64582.1, I76175, AI2360.1, A07020.1, I91962, I17250, I79375, I13706,
A06110.1, I23907, I25789, E08436, AR016396, A09896.1, A45356.1, E03738
SEQ ID NO: 56

AJ006267, AF024534, AC004981, Z74245, AC005058, X83276, X99000, AC004836.2, AB013388, L07649, U56419,
X82018, U12539, AC005516, Z69730, Z68506, AC007066.4, Z49155, Z98755, Z68213, X64963, AI322465, AA013832,
AA759527, AI627163.1, W12249, AA572634, AI156080, AI226446, AI315796, AI151867, AI272456, AI303153,
AI097795, AI196133, AI116634, AA107359, AI195426, AI046470, AA189393, U92566, AI597339.1, AA940117,
AI195524, AA967562, AI316864, AA647559, AA111221, AA792455, AV012471.1, AA326413, X85600, R08095,
AI610247.1, AA292994, AA081972, AA102553, AA482133, AA011168, AA779485, AI088595, AA779638, H24844,
T74509, R29637, AI142981, AI148247, H98197, R66629, AA946609, AI368073, AI022982, AA742540, AA632088,
W63701, H70920, AI284077, R67959, H99921, AI149779, H46510, W88776, AA427464, AA483171, AA934761,
AA779468, AI079256, AA126413, AI087197, AA932316, AA927171, AA861894, AI680566.1, AA991725, AA862664,
AA824433, AA978272, AA490994, R77334, T24004, AA877501, AA477905, N36542, H01025, AA983913, AA989298,
AA099604, C67074, AI584932.1, AI491449, AI170645, 044068, AA894307, AA859229, AI558958.1, M105426,
AI103975, C50973, AI558353.1, 048424,044717, AI626683.1, AA754347, 042717, C43398, 043675, AI658055.1,
AI066926, AA785496, AI544493, AI436934, C50485, AA849844, AI436930, AI227719, AI175549, AI175493, AI230411,
C45013, AA749555, 045663, AI657605.1, AI585100.1, AI545752, 044620, AI639175.1, AI010492, AI171392, AI172298,
E12852, I47056, E07872, AR008068, I20364, I33131, AI1101.1, I26613, A43540.1, A67171.1, E12200, AR009502,
I34523
SEQ ID NO: 57

AJ006267, Z98755, AE001148, M30039, X69067, Z82060, Z69792, AL049321.1, AC007258.3, AC003696, AF005773,
AB010076, Z83319, L00585, AC005053, A0005083, Z83744, AC004167, AA607948, AA510992, AA239196, AA990386,
AU014732, AU045014, AA178827, AA824001, AA572634, D18114, AI155491, AA692947, AI159493, AA563455,
AI131257, AI419739.1, AI034216, AI374700, AA705643, AA515776, AA678577, AA974097, AI051034, R67114,
X85601, R94086, H44493, R66383, AA364541, H42683, AA226889, AA323033, AI652089.1, AA004454, AI032100,
AI093774, AA004489, AI637941.1, AI632545.1, AA776411, N35019, W31365, AA325218, N64814, AI215614, W80495,
AA883337, AA516315, AI002701, AA553366, AA678007, AI049985, AI421684, AI583964.1, AI057313, W78760,
AA682528, AI029291, 013445,009496, AA539005, AI487416.1, M487491.1, AR008068, I74786, I26613, A30919.1,
A01967.1, A30921.1, E01702, I66313, E03799, A29216.1, A63380.1, AR019675, E02137, E03335, A09995.1, A07647.1,
A309221, A30924.1, I91443
SEQ ID NO: 58

AL049996.1, AC005071.2, S78798, U48696, Z97178, AF039698.1, AF032922.1, Y17148, U39066, AJ010903, U37573,
AF027174, AF033097, U66300, AJ004935, AF045432, AF103726, Z49980, AJ001103, AF030515, AF061786, U34048,
G29058, AF147449.1, G29060, Y15421, X99051, U65376, AF033565, S83098, U52868, AF033096, AF079586,
A0005996, X65215, A0005678, X99055, AL021997, A0004049, U44386, X80164, AE000604.1, M77492, AJ223292,
S65693, S65694, S65683, 565686, X65335.1, M80484, S83538, AC004011, D86306, U80458, X64409, AL022154,
AL034488, M22135, AF027126, X70958, AP000124.1, AF022651, S64849, AF045554, AB009287, X99568, M24488,
X65320.1, AF039399, AA981268, AA529639, AA547027, AA636308, AA068312, AA408246, AA209090, AA561951,
AA266489, AA423389, AA541969, AI046693, AA822340, AI159435, AA260088, AA968256, AI195282, AA790417,
AI173514, AF093453, AA123354, AA560141, AA529137, AI255841, AV012293.1, AA184962, AV032794.1, AA612418,
AI256251, AA867776, AA616127, W49839, W39691, AI670112.1, AA451825, AA046775, AA047503, AI565516.1,
AA370734, AA248881, AA160180, AA372829, H43466, N92184, R62724, AA215922, AA860942, AA689366,
AI478927.1, AA249712, AA092086, H58760, AA093577, N84048, N88782, N88601, N83229, N84718, N84781,
AA471338, AA095435, N83991, N84830, AA628416, AA095359, N84712, N83992, N83993, N88018, AA096046,
N89520, N55698, AA247964, AA095641, N83168, AA096066, AA247827, N84855, N86694, N55721, AA093224,
AA096061, AA249353, N87898, N88518, N87989, W23595, AA093861, AA089553, N84829, N89307, N84740,
AA215908, N88496, AA093897, AA093219, N56555, N84828, AA093313, H71118, AA095511, AA090302, N56118,
N86439, AA095475, N84016, AA089554, AA215911, AA096013, N84562, AA247828, N84723, N84575, N84921,
AI566751.1, AA095921, AA095473, N56179, N55768, N85031, N84602, N84733, N86441, N84721, AA094237,
AA247800, N84859, N84561, N84788, N55638, AF041408, AI241143.1, AI483326.1, AI483209.1, AI354060,
AI617228.1, AI353169, AI353694, AI483218.1, AI618568.1, AI618635.1, AA660164, AI353159, AI617214.1, AA933363,
AI617432.1, D41672, AU061397.1, AI616967.1, AI616416.1, AA933116, AI618808.1, AI545236, H16477, AI110435,
AU061924.1, AT000691, AI052974, AA933125, AU062120.1, AU001522, AU061975.1, AU001536, I114041, AA933253,
H63055, AA273135, 093682, AU012213, AF092795.1, AU061862.1, AA660165, AA933350, H07848, N43727,
AU061971.1, AI601746.1, AU061926.1, AU061949.1, AU062001.1, AU062063.1, A67425.1, A27635.1, I17659,

TABLE 1-continued

Sequence homologies (GenBank Accession Numbers)

A04374.1, I58669, E12149, I15713, AR007512, I85513, E08430, AI4104.1, AI4395.1, E07853, I59710, I48927,
A33348.1, AR018092, I15717, A22739.1, A22738.1, A22736.1, AI7063.1, AI8050.1, A71440.1, A37288.1, A37287.1,
A21625.1, A08586.1, I08013, I77293, A34041.1, AR018093, AI1323.1, E12434, I24703, A50146.1, A42089.1, E02074,
A22740.1, A21230.1, A20702.1, A20700.1, I05558, I83451, I83450, I43706, A46760.1, E02073, I25179, I18794,
AI33349.1, A29288.1, A26449.1, A26447.1, A23903.1, AI3387.1, AI3038.1, I05487, I06961, I92483, I24920, A23997.1,
I32615, E04616, I07816, I09132, I90245, E12615, I38604, I28832, AI7373.1, I24701, A29286.1, A25930.1, A25929.1,
A21386.1, AI3388.1, AI0871.1, A02710.1, A01519.1, I15148, AR013726, AR013725, I46906, I33632, A33354.1, I16086,
A29284.1, A31636.1, A22741.1, AI3371.1, AR009152, I90252, I44531, I48933, I32196, A34035.1
SEQ ID NO .59

AL049996.1, U67571, AL031312, A0004743, A0005734, AL021633, U34879, AF029145, AF029143, A0003002,
AF029141, AF029146, AF029139, M22645, AF029140, AC005261, A0004481, AF029163, A0006292, AB005242,
A0004514, L48937, U39742, AF067216, AL035540. Z82250, AB020859.1, AF068212, L48722, IJ48297, Z33076,
U36429, Z78015, AB007645, AF077533, U06958, AE001283, I29000, Z73423, U60136, AA547027, AI047966,
AI272485, AA636308, AA529639, W18356, AA981268, AU020091, AA408245, D19412, AA798747, AA412883,
AA589964, AA154843, AA261703, AA575188, AA140300, AA415826, AA682109, AA139028, AA571923, AA517367,
AA591578, AA412962, AI526343, W34370, AA097452, AA175157, AA408447, AA175185, AA656612, AI267112,
AI592864.1, AI315140, AA139257, AI478927.1, AI566751.1, AI655849.1, AA628416, AI637656.1, AI342003,
AA454157, AI138477, N94614, N92184, AA846238, AI292352, M376851, H71118, AA047446, AI004357, H42483,
AA934748, AI652351.1, W45047, R62724, AA373943, AA160181, AA946892, AA046636, AA833797, AI373725,
R63679, AA370734, N64387, AA741383, AI635804.1, AA160180, H25877, AA836250, AI493682, AI470888.1,
AA099298, AI560433.1, AA101822, AA884692, W79695, AA462149, AA461483, AA620825, AI204540, AI589214.1, AA701559,
AI089685, AA340350, C74979, AI022910, I169695, AA947863, N93509, I116775, AI075849, AI128109, AI379285,
AA147393, AA748524, AI123660, T87406, AA425935, AA600922, AA669848.1, AA808885, AI630110.1, 7.30155,
N80449, AA115166, AA595321, I25976, AI420334.1, H90938, N62675, AA046055, AA813646, AA824587, AI024340,
AI480039.1, AA120769, AA504327, AI198222, AI221564, AA069943, AI051089, AI129098, AI608732.1, N40801,
AA676467, AA029559, AA609419, AA639021, N71966, AA847107, AI087243, AI126049, W96128, AA135241, N30829,
M579700.1, AI045768, AA495491, AU002110, AI555626.1, AI556515.1, AI175773, AA850988, AI058737, AI231585,
H49000, AI104205, AI104061, AI579607.1, AI602655.1, AI012838, C22685, AI409652, AI172255, AA851526, AI101654,
AI007826, AA848630, AI112250, AI172256, AI584197.1, AI626350.1, AI461286, M035127, AU036743.1, I09267,
I09270, I09268, I09269, I09252, I09251, A39595.1, A60955.1, A70359.1, A68104.1, A64973.1, A60975.1, A60210.1,
A58525.1, I72268, I70384, I66490, I69298, I62993, I60241, I44531, A49949.1, A42847.1, E02293, E02431, E01024,
I18795, A21895.1, A21625.1, AI0360.1, A08457.1, A07700.1, A07699.1, A02228.1, I08776, A71440.1, AR000006,
A63067.1, A58998.1, I72269, I70974, I66485, I66484, I66483, I63561, A49258.1, E02679, E02096, E01693, E01503,
E01148, I28266, A23373.1, I15368, A29289.1, A24782.1, A04190.1, A02712.1, A02230.1, I09342, I01578, A58526.1,
A58524.1, A58521.1, I86203, I66497, I66489, I60242, I58439, I44515, A39929.1, E02291, E02104, E00954, E00635,
A27170.1, A28163.1, A27396.1, A25909.1, A20702.1, A20502.1, AI8053.1, AI3392.1, AI0361.1, AI0359.1, A08030.1,
A05160.1, A00781.1, AI3393.1, A70040.1, A65599.1, AR015960, AR007269, AR002333, A63064.1, A60990.1,
A60211.1, A60209.1, I74623, I26930
SEQ ID NO: 60

M55543, M55544, M63961, M80367, AF077007, AJ007970, U44731, M81128, AC006487, X77129, Z95388, Z78546,
U06117, Z28127, X72016, U39487, Y10720, D10044, X92112, AL035640.2, AB020867.1, AI528561.1, AA122936,
AA880099, AA174655, AA709608, AA139382, AA175795, AI386222, AI180927, AA153021, AA177644, AA833283,
AA153027, AI007134, AA277123, AI036133, AA184762, W13273, AA050005, AA183500, AI194988, AA637915,
AA114752, AI529783, AA591158, AA623124, W11962, AA572614, AI226959, AA636826, W09157, AA656934,
AA930058, AI196439, AI265579, AI507911, AA615757, AI255257, AA771075, AI196650, W14549, AI173439,
AA537760, AA871548, AA623233, AA596947, W18580, W59642, AI116637, AA674847, AA871853, W09680,
AA690356, AA690345, AA592134, AA929451, AA726211, AA815536, AA673795, AA575826, W08242, AI526861,
AA871760, AA637894, AA796453, AI526944, AA871454, AA637995, AA726213, AA619507. AA792581, AA727850,
AA710108, W10630, AI527364, W40592, AA882297, W74981, AA575817, AA530022, AA796572, AA727764,
AA710331, AA756070, AA796620, AI265469, AA710332, AA871738, AA871524, AI118208, AA710753, AA518765,
AA590563, AI255577, AI265458, AA727837, M255565, AA871728, AA815514, AA876142, AI439472.1, W37973,
AA075477, AA622193, AI492530, AI500511.1, W37755, AA642656, AI500507.1, AA837842, AA075671, AA587444,
AA635989, AI285460, AA131850, AA937007, AA903286, AI251115, AI289455, AA533156, AI084027, AA586545,
AA627607, AA532369, AA579973, AA917383, T29528, AI138455, W72748, AI073859, AA471169, AA044192,
AI683358.1, AI371522, AA424070, AA164464, AI683206.1, W01896, AA100063, AA305909, AA487528, AA354725,
H05350, AA315174, AA827350, AA486849, P06345, AI051732, AI075062, AA937600, AA347633, AA650178,
AA510201, AA131800, AA837672, AA424529, AA486850, AA044017, AI280597, AA834863, AA294763, AA487747,
AA424397, AA610352, AA056488, AA564905, W77927, AA487367, W37972, AA337079, AI372935, AA587703,
AA911189, T87056, F07031, AA878690, AA873192, H05300, AI246407, AA576498, AA263171, AA296485, T83604,
I75545, AI400402, AA294979, AA947554, F05698, AA158924, AA372968, AA506001, AA848004, AA582749,
AA057242, AA665504, AI651570.1, F23076, F14838, F14828, AI626652.1, AI397188, AI411266, R65420, AA955194,
AA494665, T43327, T41892, H36685, A57938.1, A62526.1, A62517.1, A62525.1, A62523.1, A62514.1, A62529.1,
A60110.1, A34791.1, I61340, E02077, I22020, A61387.1, A34793.1, A34797.1, I91962, A34798.1, I02047, A57732.1,
A30009.1, A30008.1, I61357, I55887, I36931, I22021, A23331.1, I61339, A34792.1, I51958
SEQ ID NO: 61

AC004890.2, D44464, U69607, AC004287, AF022713, U65480, AF007190, AA023318, W34889, AI325217, AA020155,
AI099015, W08125, AA171085, AA475225, AI428114, AV021511.1, AA530037, C81483, AI120505, W82682,
AU044036, AI550872.1, C81053, AI606072.1, AI482241, T58810, AA403044, AA404342, R51103, AA411125, H90789,
AI656091.1, C01674, N46452, AI038763, AI125451, AA748144, R53731, R32580, AA336273, AI060054, AI412971,
AI010977, AA817712, AA943539, AA945937, AA924941, AI575036.1, AI235973, AT000005, I08514, A52461.1, I15007,
I40796, I40797, E08841, I76943, A22413.1, E08842, I40802, I40794, I76961, AR007335, AR007334, I40803, I59546,
I40801, I40795, I40800, I40799, I40798, I40793, A22416.1, I40792

TABLE 1-continued

Sequence homologies (GenBank Accession Numbers)

SEQ ID NO: 62

AF062530, AF062529, Z98036, AC002098, Z66560, M20162, AC000396, AB012242, Z83001, Z73972, AF015725, AB008267, AC004466, Z48305, X14710, AC005268, AI158210, AI607860.1, AI020516, AA734832, W82466, AA061808, AI585869.1, AA929800, AA124107, AI464206, AI303901, AI270576, AA349855, H60027, AA639612, R25924, AI014725, AA092495, W58640, N55875, R14767, D21042, AA446652, AA086458, AA781029, AA629918, AI032793, AA573873, AA643067, R34884, AI654799.1, AA479474, AA030012, AA594551, AA838460, AA447455, AA148791, AA256802, AA150300, AA505932, W05069, AI493530, AI086076, AI289025, AI126256, N51389, AI435022.1, AI652271.1, AA701889, AA159318, AA404221, AA504833, AA700625, AI144326, K05385, H84256, AA404687, AA096477, AI553943.1, AI590335.1, AA975658, AA836652, AA66321.1, AI366976, AA767837, AA836632, AI201421, F29452.1, C18263, AI420308.1, AA223701, AA353488, X93835, AI436132.1, AA338652, AA835733, AA120828, AA313515, AA683145.1, AI179962, AI178673, AI179961, AA951467, AA736165, AI113962, AU033961.1, H34335, AI388669, AI546326, AA950955, AF091037, AA056808, AA441103, I28420, I40904, I40899, I28996, I29683, I08242, I55123, E03428, I09285, E03204, E03201, I17289, I17288, I30049, I82816, I43726, I08241, E03981, I08247, E02518, A51133.1, I08243, E03202, E02829, I08244, E03203

SEQ ID NO: 63

D13979, D14289, X79990, D14821, S78158, D32007, X79989.1, AF018282, AC007161.1, AC003006, AE000663, AI224792, AJ011500.1, AC005058, AF004221, K03329, Z70782, AF109907, X16300, M17293, D49507, AL034365, S55844, M13209, J02070, M17416, M57768, X67119, X16144, M80517, K01729, AJ224790, X01978, V01555.1, AU041415, AI604144.1, AA469776, AA469797, AI181996, AA125063, AI116642, AA764486, AA170124, AI119539, AI413228, AV018765.1, AI591747.1, AA645716, AA734228, AA245794, AA458335, AI420591.1, AI033811, H94855, AI167424, AI264845, AA904353, F02579, N75054, AA992855, R38996, N86959, AA247686, AI078840, F01701, AI080687, N88058, AA463390, AA095305, H46432, AA194741, AI476165, AA257797, AI574526.1, AI639156.1, AA901073, AI640928.1, AA851803, I30202, A37267.1, E05655

SEQ ID NO: 64

X79990, D13979, 578158, D14821, D14289, X79989.1, D32007, D14823, S78159, AF018276, AF018275, AFO18283, D14822, AF018274, AF038029, AB010420, AB010419, AF018277, AB013280, AF052215, S74096, AF068266.1, AF039200, AF069747, AF052210, AL034421.4, AF022978, I24038, AC002297, AJ005682.1, AC004011, AL022721.1, AE001039, AL008634, AJ005077, Z84466, X77694, AC001229, AA597034, AA261311, AA222011, AA674424, AI046358, AA222118, AI152215, AI606504.1, AA822901, AA914494, AA529559, AA015563, W89980, AI530389, AU044402, AA238326, AU046282, H18342, H18378, R91340, R70443, N75171, W39519, AA132116, Z39533, AI572746.1, AI683617.1, W38699, N71935, AI565447.1, AA450258, AI183938, AA099446, AI559642.1, AA758952, R40796, N73391, AI171652, AA996736, AI407074, AI176767, AA963424, AI169429, AA924939, I30202, AI4660.1, I23902, I18688, I18460, I23917, I92571, I92569, I13528, I92570, E12884, AI1181.1, AI1180.1, E12862, I23473, I68122

SEQ ID NO: 65

AB012290, AJ224115, Z99128, AB006036, U92456, AF043288, AC005070, AF043289, AB017067, D13447, AL023634, AC005220, AB023037, AL021180, AB006605, AF002725.1, AF052290, AE000541.1, AL022311.5, AE001458, AA060080, AA492926, AU051027, AA864027, AI605657.1, AI595541.1, AI414590, AA537749, W12836, AA968079, AA062255, AI507200, AA863700, AA086829, AA230881, W17622, AU016791, AL048784.1, AA382461, AA211241, N28924, AI038250, W92175, AA428487, N23469, AI184192, AA553654, AI032748, AI127471, H98745, AI199780, AI200995, AI018139, AI247996, N35218, AI018413, AI000892, AI075315, W92176, AA479899, AA573426, AI248681, AA972378, AA971235, H37900, AA187099, H38682, AA935226, T69954, AI458606, AA526585, AA661672, AI626169.1, AI599584.1, AI555245.1, AI296396, AA891069, AI556934.1, AI165512, M88926, AA042641, AI163944, AI353541, R90536, AA497294, AI167032, D87223, AU060083.1, I26663, I26665, I19883, E08855, I09331, E03154, I62371, I09329, A49549.1, I09328, I08294, I71894, I06440

SEQ ID NO: 66

Z99128, AB012290, AJ224115, AJ005937.1, AC004116, AL023534, AI648020.1, AU020306, AU024203, W11581, AA764641, AA097370, AI325483, AA024303, AI006140, AA798365, AA122933, AA450512, W36820, W08677, D19317, AI152339, AA408261, AA537961, AA869453, AI194970, AI385488, AA986211, AI573797.1, AA061055, AA821888, AI672149.1, AI126291, AA490202, AA629288, AA921804, R78142, AI076709, I77446, AA284106, R29335, R78141, AA323127, W25929, N76402, N77083, AA383402, N36259, AA373583, AI598063.1, W73010, H26379, AA059466, AA915976, AI458262.1, N24536, AI034064, AI630968.1, AA899108, AI235699, I24037, AA550072, C93780, AA965029, AI485592.1, AI490346.1, AA908042, AA92646.1, AI050201, AA952525, AI065367, I26663, I2344.6, A26668.1, E05206, A40099.1, AR022664, I31892, A51135.1, A40106.1, AR022657, A40098.1

SEQ ID NO: 67

L18880, J04126, Y00312, L13300, S52276, S52271, U66300, AF027174, U37573, AF039698.1, AF045432, Z97178, AI010903, AF103726, U48696, U39066, AF032922.1, Y17148, Z49980, AJ004935, S78798, AF033097, AF061786, AF030515, AJ001103, Y15421, U34048, G29060, G29058, AF147449.1, S83098, U65376, AF033565, X99051, U52868, AF033096, AF079586, X99055, U44386, X65215, AF067624, X80164, U82828, U55724, S65693, S65694, AC007138.1, AF047564, X52256, S65683, AI223292, S65686, X64409, X91233, AF027126, X70958, M22135, AC005026, AF147259.1, X99568, M80484, X65320.1, M24488, S83538, X65335.1, AI042965, AF093453, AA472473, AI115061, AA472598, AA457950, M153412, AA881157, AA239775, AL048129.1, AA853564.1, AA471338, N84830, AA247827, N88782, H58760, N83993, AA093224, N83229, N83991, N55698, N84048, N89520, N84712, N87898, N84855, N88601, AA096046, AA095359, AA096066, N84718, AA095641, AA247964, N83168, N86694, N83992, N87989, AA095435, AA093577, AA096061, AA249353, N84781, AA249712, N88018, AA092086, N55721, N88518, AA093861, AA089553, N84765, N56555, N84829, AA215908, AA093897, N88496, N84828, N89307, N84740, AA093219, N56118, AA093313, N84016, AA090302, N84723, AA089554, N84723, AA095511, AA215911, N84562, AA247828, N85031, AA094237, N84602, N84733, N84875, N84921, N86441, N56179, N84575, AA095475, N84721, AA096013, N55684, N55681, N55768, N84561, AA095921, AA095473, N84662, AA247800, N84764, N55669, N55700, N55641, N55659, N55697, N55639, N84859, N84874, N84722, AA249323, N85900, AA249064, N55653, N84873, AA248551, N84797, N85930, AA095919, AF041408, AJ241143.1, AI483326.1, M483209.1, AI354060, AI353169, AI617228.1, AI353694, AI483218.1, AI618568.1, AI618635.1, AI353159, AA660164, AI617432.1, AI617214.1, AA933363, AI616967.1, AA585825,

TABLE 1-continued

Sequence homologies (GenBank Accession Numbers)

AI616416.1, AI616808.1, AA933116, AU004045, AU004063, AU003308, C93848, AU061971.1, AU061862.1, W43681,
AU012213, AU061926.1, AU062120.1, H07848, AI353413, AU061949.1, AU062001.1, AU062063.1, AU061924.1,
AU061975.1, AU001522, AU001536, AA618732, AI066886, AT000691, C93682, A04374.1, A27635.1, I17659, I90252,
E08428, AI7373.1, E12149, AI7374.1, AR009152, I48933, AI7063.1, E02958, A05144.1, AR007512, E08429, AI4395.1,
I32196, I24105, I08013, A29289.1, A25918.1, A25917.1, A08586.1, I59710, A45792.1, E08430, E04616, I28830, I15717,
AI4104.1, I18794, A26449.1, A05143.1, AI7064.1, I24104, A33348.1, A22739.1, A22738.1, A23903.1, I15713,
A37288.1, E07853, A37287.1, A34041.1, A22736.1, A20700.1, I24701, I77293, I25179, A33349.1, A20702.1, A71440.1,
AR018093, AR018092, E12434, A50146.1, E02074, A22740.1, A21230.1, I43706, I48927, A42089.1, AI8050.1, I70384,
A26447.1, A29288.1, A21625.1, AI3387.1, AI3038.1, I06961, I05487, I07816, I92483, I83451, I83450, I85513,
A46760.1, E02073, AI7370.1, AI1323.1, A01519.1, I15148, E12615, I38604, I24920, AI3371.1, AI0871.1, A02710.1,
I05558, I09132, I90245, I46906, IU531, I24703, AI3388.1, A29286.1, A23997.1, A21386.1, I66485
SEQ ID NO: 68

Z50070, AC005405, AC006979.2, U80443.2, AJ005821, AV011931.1, AA218244, AI385712, AI462105, AI428532,
AA097078, AI120426, AA275245, AA871884, AI509894, AA168615, AA522413, AA222085, W36524, AA709795,
W08491, AA500709, AI648883.1, AA039140, AA986882, AA163074, AA451366, AI325541, AI615295.1, AI481672,
AI037075, AI662626.1, AA684194, AI649000.1, AI591703.1, AU016270, AA667101, AA734486, AV013533.1,
AA125031, AA476011, AA789350, AA497964, M587926.1, AL048130.1, AL047646.1, AI564569.1, C06476,
AI564600.1, AI583605.1, AA776250, AA564112, AA486728, AA458903, AA284505, AA744683, AA744677, AI041865,
N35013, AI367320, AA478033, AA723251, AI161355, AA521095, AA653613, AA173528, AA160880, AA653144,
W72421, AA031689, AI095313, AA744691, M243169.1, N27658, AA909152, AI381956, AA548423, AI240491,
AA150688, AA705238, W76280, H24935, AI290052, AA099284, AI003089, AI041158, AA299485, H47593, R87481,
H06272, AA670014.1, H62215, I92938, F32136.1, W15223, H28559, AA045285, H57205, AA490932, R78919,
AA165451, AI206471, AA370855, AA853565.1, I92716, H51597, AA831147, H38452, T23463, AA776247, I93331,
H97605, I92712, AA904909, R62767, AA568274, AA385864, AA814518, R71478, AA887917, AA833577, AA936405,
T92721, R89767, R26297, AI240490, AA975607, AA975610, AA132058, I94009, R33615, AA719744, AI381794.1,
AA523772, T27752. M675329.1, T55025, AA340520, AA640536, AA090531, T54861, AA459097, AA564540, H99789,
AI136460, AA900065, AI010678, AI230737, AI599236.1, AI105068, AI412135, AA955854, AI011100, AA955166,
AA597982, AI104512, E05646, A39800.1, A39798.1, A58656.1, I09386, A37005.1, I34189
SEQ ID NO: 69

X98494, Z83848, D87023, AC002060.2, AF036707, AF022981, AF125969, IJ76408, D87010, AF046084, AE000127,
AF120927.1, U08110, AP046092, YI8000.1, Y14591, U53154, U85198, D87009, AF036359, AF028710, U65020,
Y14592, U48809, AF057293, IJ90439, AE000661, U20857, U18428, L05251, U10577, AF047659, U97079, Z93375,
Z49908, M63783, AC005965, AC007061.2, S76016, Z68328, AL021107, X96469, Z73905, AF030052, AC004051,
X16561, U67889, AL031652, S74622, AF025452, Z95113, M37129, AC005927, U40375, AB026647.1, AB027513.1,
X06862, M60858, M17571, AP000076.1, X06856, AB011164, U58652, L05904, W75630, W64795, W33952, AA388279,
AV020965.1, AV024242.1, AA822594, AA611358, AI666755.1, AI664403.1, AA217227, AA274596, AA667372,
AI661115.1, AI551976.1, W62996, AA103552, AA120182, AA675019, AA895561, AA183615, M020280, AI666759.1,
AA240412, W81743, AA178559, AI194355, AI159163, AA968004, C85953, AA259950, AI183094, AA013544, W18876,
AA407843, AU023725, M508428, C87289, AA061215, AA259498, AA030860, AA117303, AA268047, D18368,
AA414028, AA285757, AA821550, AI527508, AA967944, C86912, AA572380, W74843, AA848124, T24602, AA603307,
AA159246, W73654, W01754, I92366, I93760, AI096565, AA159236, W70267, I90227, W26394, W28236, I92399,
AA054682, AA329899, I92391, H99855, AA131115, W73607, AA147878, Z78377, AI080454, AA044888, W26028,
I94225, I93759, I94254, I90230, AA166879, W27620, I93753, AA551443, T63911, I93558, I94665, I90616,
AI273114, I94922, W28045, AI070777, AI137651, C94041, AI546038, L37652, AI406906, AI641607.1, R90246, I75711,
AA908051, AU062784.1, C46974, AI295651, AU060842.1, AI054913, AI296000, AU033967.1, D68715, C49179,
AI443037, AI384793, C99888.1, AA958114, AI294740, C96722, AA950741, AA497303, AA495228, D36000, AA202384,
AI044390, AI257069, AI514933, N83025, AA842900, D74159, AA952144, AI216940, U78748, AI253455, AI239345,
AI539928, C09348, C43842, AA651326, AI437064, AI476857, AI548859, AA941414, C96769, D35760, C09488, C45265,
AI102403, C49820, AU039361.1, AI043616, C44692, AU037725.1, AI540027, C83963.1, A50142.1, I55033, I87853,
A00764.1, I23464, AR013966, E12103, I28325, I71491, I19108, AR003567, I71490, I28591, I91502, A59205.1, E06594,
I23439, I91514, I38225, I80921, E05541, E05543, E08652, I11571, I09218, I68135, A46292.1, I11583, I68134, I09219,
I12143, A22942.1, A45346.1, A30331.1, AR022373, AR022395, A30330.1, A32827.1, A58691.1, A30354.1, E05544,
I12142, E02506, A46291.1, I12873, I34431
SEQ ID NO: 70

X98494, AI386428, AA162148, AA213194, AA881872, AI647220.1, AA590060, AI326008, AA619205, AI284853,
AI222419, AA992199, AI681988.1, AA992130, AA025657, AI087795, AI263606, AA083314, AI094541, AA847842,
AA731098, AA047545, AI420376.1, W80758, AA770202, AI357730, AA909134, AI271912, AA810790, N68965,
T97061, AI056034, AA668325, AA504113, AA347116, AI244315, AA837327, Z25156, AA888598, H88801, F00393,
AI679289.1, AI679865.1, AI000365, H89025, T96950, AA916136, C02251, AI177638, AI406906, AA817668, AA901350,
AI483281.1, I56746
SEQ ID NO: 71

AF035606, U37573, U49112, AF052186.2, AF053408, X53937, AJ007829, AD001531, D50010, D78345, Y09813,
U51113, L08785, U02430, M77811, U43955, U41513, AF053407, Y16359, U43957, U39779, U43956, U02437, U7031.1,
X52326, L08786, U14119, L08784, U08787, U02449, U43954, L26977, U02457, AT234771.1, L08783, AF053409,
X52325, U01668, L08782, AF054625, M29362, U69698, X52324, M68946, AF128862.1, Z29589, AF038666, M29363,
X52331, AF053406, D61393, AF078810, X98363, X82190, AB015619.1, U14118, U14121, U14116, U84006, AF005420,
AJ005339, AJ005324, AJ005323, IJ89927, L08874, Z32836, AF118920.1, U47102, AF041426, Z47173, U47103,
X65334.1, X65316.1, X65314.2, X65306.1, Z47159, X65315.1, U25268, U25272, AF092546, X65309.1, X65308.1,
X65311.1, X65307.1, X65310.1, X65313.1, AF092940, X65304.1, U03442, U03440, U03435, U03438, U03436, U24178,
X81969, D13509.1, U48696, Z97178, AF045432, U39066, AA855573, AA959713, AI646046.1, AI415428, AA116476,
AI324822, C85464, AV012020.1, AU019447, AV028650.1, AV033871.1, W36252, AV044086.2, D77020, AA213236,
AI314599, AI314940, AI429791, AV033821.1, AI316230, M573864.1, AI661543.1, AA254914, AI132558, AA168802,
AA710186, AF093453, AI315071, AA881316, AI197054, AI256149, AI527428, AA238081, AI152451, AI132585,

TABLE 1-continued

Sequence homologies (GenBank Accession Numbers)

AA238390, AI121035, AI099353, W13766, AI157500, AA871944, AI132345, AA825538, AI522238.1, AI572080.1,
AA831357, AI360561, AA775261, AI140796, AA835492, AI361820, AA100279, M277190, AI469550.1, AI015234,
AA581345, D20022, AA122332, AI355770, AA485257, AA092467, AI471817, T34498, AI597962.1, AI624976.1,
C14723, D57491, D55233, C16300, C16305, AI541540, AI526201, D61254, AI540858, M557252.1, AI526143,
AI526136, AI547006, AI557262.1, AI557271.1, AI556966.1, AI540876, AI546949, AI546984, AI557859.1, AI557866.1,
AI541513, AI547042, AI541110, AI540926, Z28355, AA585101, AI541528, AI526059, AI541522, AI557850.1,
AI525316, AI541541, AI525306, AI541523, AI541396, AI526150, AI526092, M526198, AI557861.1, AI557863.1,
AI546875, AI546896, AI546940, AI541530, AI546837, AI557856.1, AI541521, AI547171, AI525296, AI541390,
AI547116, T41289, AI547165, AI546999, AI547080, AI547147, AI525431, AI541537, AI546917, D57186, AA174170,
AI525500, AA585439, AI541374, R29177, AI525204, R29218, AI541535, AI526045, M557731.1, D53447, AI557799.1,
AI525556, C16293, AI541307, C15069, AA660699, AA751703, AI058193, AA441129, AA695353, AA696974,
AA521091, AA816610, AA697069, AI021792, AA694821, AA696904, AA803031, AA695217, AA802872, AA753798,
AA802568, AA751523, AA696639, AA698105, AA525623, C94908, AA754494, AI215223, AI374340, AI215263,
AA751866, AA751952, AI374376, c06511, AA754497, AA751691, AA752525, N98067, AI563441.1, AA525581,
AA052885, AT001210, AI215226, AA751833, AA751907, AI507946, AI563445.1, AA803406, AA735727, AI215264,
AI215215, AA751591, AA751592, M096152, AI215210, AA752541, AA695930, AA697684, AA802970, AI374225,
AA754313, AA750210, AA751934, D43391, AA694838, AA735768, AA697195, AA698716, AA750248, AA080594,
M021791, AA539955, AA751578, AA752036, AA750187, AA751554, T00697, AA751859, AA696794, F20138, R46884,
AI180308, AA956495, AA753213, AA819488, AA818950, AA851164, AA439637, AI014075, c06771, AA751850,
AA752256, AA752020, AA566697, AA961326, AA754338, AA751678, T24259, AA080579, T15066, AA751446,
AA754399, AA751589, AA754496, I18794, A25909.1, I69323, I69324, I63120, A20702.1, A43188.1, A20700.1,
A43189.1, I84553, I84554, I05558, A64973.1, I70384, E03627, A60210.1, I06859, AI8050.1, I48927, A60111.1,
A60211.1, A23633.1, A02712.1, A60212.1, AI8053.1, AR007512, A23334.1, A60209.1, I13349, AI0361.1, I49955,
AI1178.1, E01007, E13740, AI1624.1, E00609, AI1623.1, I00682, I38604, A70869.1, I44681, A04664.1, A02196.1,
A35536.1, A35537.1, A04663.1, A02195.1, A58522.1, I62368, AI3393.1, AI3392.1, A02710.1, E12615, I03331, I44516,
A70040.1, I21869, A07700.1, I28266, I44531, I49890, I13521, A27396.1, I52048, I21170, A58523.1, I15717, I15718,
A58524.1, A24782.1, A24783.1, AI1245.1, I18895, I33154, A70872.1, I08396, I08389, I08051, I60242.160241, I26927,
I26930, I26928, I26929, I25027, I01995, I44515, A22738.1, I66494, I66495, I66487, E00697, E00696, A20699.1, I09126,
I85655, I08395, I05845, A22734.1
SEQ ID NO: 72

AF035606, U49112, AC004485, U73627, AC000389, AE001146, D89223, AC004923, AC000385, U03396, Z95397,
AI324822, AA959713, AA116476, AI415428, AI646046.1, C85464, AV012020.1, AV028650.1, AA855573, AU019447,
AI314940, AI429791, AI314599, AI316230, AI573864.1, AI197054, AI661543.1, AA881316, AA825538, AI522238.1,
AA831357, AI572080.1, AI360561, AA775261, AI140796, AA835492, AA100279, M277190, AI469550.1,
AI015234, AA581345, D20022, AA122332, AI355770, AI471817, AA485257, AI597962.1, AA0924.67, T34498,
AI624976.1, AA089786, AA323239, N66311, AI583131.1, AA235383, AA749042, AA424515, AA918245, AI251010,
AI492326.1, N21277, N75967, AI538241, AA747919, AA836065, AA555024, AA829834, AI292114, N32584, AI291299,
T06835, AA551164, AA819488, AI014075, AA818950, AA956495, AI180308, AU060744.1, M411437, AI137403,
AI408578, AI230355, AI411858, I57316, AI0265.1, A07704.1, I82512, A26415.1
SEQ ID NO: 73

AF089816, AF032120, AF089817, AF089818, AF061263, AF104358, AA396587, AA839164, AI645842.1, AA259652,
AI462731, AA396061, AI508747, T25830, W06974, AA300306, AA158704, AA702414, AI335709, AA974969,
AI193578, W87364, N39553, AI669881.1, AI424712.1, AA513461, R10174, AA565967, H25130, AA468577, AA367767,
AI418022.1, H49150, AI369600, T52003, AU056473.1, AR012064, I87064, I84560, I65545
SEQ ID NO: 74

AF028824, AF089816, L38482, AE001104, AL033502, AC005757, U34830, AC004076, Z11490, AJ222796, AL022069,
Z75543, AC006056.2, AC006508, AA285636, AA711082, W64914, W20880, AA172932, W09810, AA793773, W62886,
AV026607.1, W18328, AA734581, W53794, AA674963, AA175523, AA222652, AA286301, AA067058, AA727901,
AA692352, AA608460, AI429553, AA216860, AA163431, W97171, AI286788, AA450721, AA273318, AA267167,
AA203863, W98132, AA733321, W61471, W10683, AV042841.2, AI662163.1, AA691246, C76145, AA597140,
AA178040, AV041261.2, AA929100, AI586270.1, AI324366, AA512291, AA638455, AA217257, AA138312,
AV040396.2, AA869209, AA822151, AA710587, AA689043, AA178370, AA152940, AA122810, AA571067, AA529128,
AA276820, W53574, AA175721, AA146102, AA137743, AI528673.1, AI504720, AA464870, AA616238, AA183539,
AA172429, AA170209, AA145390, M325168, AA616060, AA267185, AA139433, AA125142, AA688934, AA689641,
AA267963, AA221937, AA220370, AA170764, AI530662, AA733250, AI660895.1, AI472081.1, AA781474, AI073909,
W73036, AI032395, AA581812, AA149940, AA535595, AI085734, AA666165, AA579893, AI624402.1, R32110,
AI241188, N64621, AA740666, AI589363.1, AA677956, AI343472.1, AA878576, AI634734.1, AI423229.1, R50716,
AI683679.1, AA705739, H64249, AI272198, AI654473.1, AA325291, AI672928.1, R40181, AA612759, AI499113.1,
AA404606, AI270050, AI056166, AA995431, AI289585, T54484, AI218312, AA918644, R33590, R32109, T30333,
R09164, R77191, AA404222, AA304135, R33694, AA160211, AA320369, AA135772, AA135729, AI392813.1,
AI370449, W73301, AI298917, AA160212, T16203, AA434159, N78888, AA295659, T48755, AA487316, N55776,
AI245392, AI366949, I25831, AI278660, AI364244, H64248, AA150525, N79950, R09267, R80211, AA157962, T73936,
AI597799.1, R98601, AI374943, H50728, AI298607, AA423820, AA622465, AI569836.1, R55012, H44307, AA282809,
AA419079, AA206818, AA371801, AI090123, AA506994, AI298776, AA436972, T82181, F22959, AI228589, AI013903,
AI562315.1, AA697640, A70195.1, I25849, I78457, I62859, I08631, E01324, I08638, I15551, I07396, AA44968.1, E08433,
I42577, A68700.1, E01495, I68738, A08267.1, A45357.1, A46785.1, A23164.1, A42378.1, A45334.1, A08269.1,
A65720.1, AR022391, I80845, A45372.1, AR022409, E06904, A46718.1, I14085, AR022411, I12883, AR022381,
A08862.1, I13029, I50851, A46720.1, AR022410, A45340.1, A70680.1, I80847
SEQ ID NO: 75

X03205, U13369, M10098, K03432, X82564, X00686, M11188, X01117, V01270, X06778, K01593, X00640, D84514,
X04025, X59734, M97576, X59733.1, M91180, AF115860, X02995, I00999, K01373, X98843, M91182, M91181,
M91179, M91183, X98841, X98846, L11288, X98844, AF102857, U87963, X98840, X98837, D50494, X98842, X98838.
X98836, X98839, X98845, AF030250, M33066, M59402, I24123, M97575, M59384, M97573, M59393, M59401,

TABLE 1-continued

Sequence homologies (GenBank Accession Numbers)

M59392, M59386, AF021880, M59385, M59391, M59387, M59399, M59397, AJ007613.1, L81946, X70210, AJ007614,
U50968, AF062955.1, U08333, X81631, X80233, U08327, L11230, L11266, L11270, U93555, X79877, AF025946,
U36271, AF062954.1, U19519, AF062950.1, X91974, U12647, L11269, M59388, M59396, AF062964.1, AF062947.1,
X87985, U88337, L11267, AF103730, AF099943, L11268, Z83753, Z80955, AF021879, AF099942, U08325, U08331,
U08329, M59390, U67324, AA409121, AU023662, AA407434, AU020382, AA409846, AI256506, AA914790, C86941,
AI132252, AU035733, AU021041, C87199, M322276, W20927, D19503, AI324724, AA114639, C88357, AA895334,
AI546975, AI547168, AA090106, AI547131, AI524874, P29913.1, P27302.1, F24428.1, AI547125, AI547156, AI547139,
AI547184, AA215893, AA092005, AA247334, AI557155.1, F27796.1, H43062, AI547170, AA585468, AI540955,
AI547195, AI547112, AA248417, U46270, AI547189, AA094658, AA336280, AA095372, N25575, AA502901,
AA360125, AA360124, F34726.1, AA669617, AI032872, I29140, AA369101, AA585173, AI554412.1, AI635062.1,
H465 73, AI289938, AI283315, H42931, AA506222, N86367, AI354556, AA532838, N88979, H50362, H45047,
AA094430, AA346313, U46222, H41656, H26440, AA095425, N44063, F29193.1, AA728882, AA715534, HI 8223,
AA725242, H23882, AA911513, AA714262, AA809098, AA074261, H26690, AA360197, T94543, AA092500,
AA484257, H96223, AA378312, AA318469, AI452940.1, M547166, AA093380, T93007, AA481974, AA300605,
H18966, AA361972, AA515044, AA569231, R82750, T82440, H52350, AA455819, R71893, AA728869, AA744120,
AA360304, AA713764, H52327, AA378126, AA828929, H61354, AI241168.1, AA900286, AI058227, AA850573,
Z71889, AA991117, AI230423, AI408809, AI407879, AA850888, AA850889, AA944702, AI058228, AI008416,
AI083253, AA228229, AA052022, AA273117, AA057965, AA598354, AA545824, AA598355, AA280468, AA022350,
AA570908, AA430839, AA224630, AA842564, AA257199, AA232024, AA253533, AA991043, AA514179, AA570837,
AA056804, AA253514, AA406738, AA471543, AI087484, AA257416, AA056821, AA280496, AA990956, AA585660,
AA224628, AA080798, AA842506, AA273099, AA24.6088, AA023868, AA471501, AI105694, AA022420, AA514160,
AA675823, AA231991, AA051980, AA661367, AA842135, AA598367, AA052055, AA433431, AA471489, AI083303,
AI058023, AA417401, AA570918, AU000884, AU001347, AU000812, AU001068, AU001611, AU001774, AU000888,
AA570916, AU001817, AU001353, AU001781, AU000838, AU000775, AA052026, AU000916, AF091041, AU001977,
AU000763, AU004020, AI082942, AA570824, AA228228, AI087453, AI629970.1, AI621757.1, AI621756.1, AA480713,
H52877, AA651576, AA991088, AA471400, C95447.1, AA228160, AR022116, A07562.1, A70359.1, E01321, I69485,
I09303, I27617, I69461, A21385.1, I58610, AR015960, E01508, AR000007, I58595, I65402, AR000006, I08115, I16573,
AR015961, I90051, A49389.1, E06998, I16572, I58596, I58609, I85654, I85656, I72268, A33044.1, A67356.1, A57359.1,
A67368.1, A67338.1, A67269.1, A67359.1, A27396.1, A67336.1, I26929, A67265.1, E07334, I79228, E08821, A48778.1,
A48781.1, I14456, I14452, I14455, I14450, I14453, I14451, I14454, I33579, A51866.1, A67262.1, A67300.1, A67291.1,
A67267.1, I92570, I18898, A22424.1, A39827.1, I26928, A02365.1, A48775.1, I67829, A48776.1, E01246,
A63774.1, A63776.1, I68031, E12844, I14936, I25006, I36197, A63954.1, E01510, A58741.1, A48774.1, AR019620,
I16901, I40370, E01315, E01316, A58742.1, I60004, E07337, E03076, I62976, I89769, A48779.1, A48782.1, I60003,
A58738.1, A58740.1, AR022119, AR022118, AR022117, A60858.1, E03345
SEQ ID NO: 76

AI477953
SEQ ID NO: 77

MK3710/T3 5'AF025438, AL024458, AC005539, X79080, Z48544, AC004455, AC005966, U63928, AC004680,
AA137279, AA541923, AA000683, W10638, W43974, AA000401, AA003291, AI461713, AA637410, AI585560.1,
AI430072, AA759800, AA546383, AA607321, AA110039, AU024430, AA959647, AU024429, AU022981, AA600493,
AI430557, W15850, W58718, N32746, AA024784, AA313566, AA236836, AA007319, R72404, AA236656, AI090162,
AI630438.1, AA701988, AA852227.1, AI337332, AI630424.1, H30501, R17187, AI304319, AA236789, H25699, N56244,
AA865602, AI631687.1, N66532, AI076924, AA452088, AA916723, AA024685, AA007455, AA916358, AI336121,
AA521369, AI167263, AI283104, AA345744, AI140745, AA451907, AA995467, N23163, R77800, AA505618,
AA913049, AA385531, AI538205.1, AI073755.1, AI352390, R72405, R41738, AA670386, AA334614, AA228391,
AI625253.1, AI637995.1, N70197, AI648548.1, AA148868, F08701, AA216042, AA358819, H35482, AA687041,
AI599140.1, AI171338, AA979853, I23866, I27840, I27838, I08198, I40308, E05224, I85624, I27866, I27845, I27844,
I27842, I27841, I95863, I27839, I38154, I27837, I27830, I27829, I68296, I68289, I32039, I07691, I03244, I01972, I05124,
I07865
SEQ ID NO: 78

AF025438, U42838, AL031055, AL024458, AB009052, D17798, AB005234, AC000389, Z92844, AL032654, Z68335,
D17799, AC004680, D17797, AB006621, AC007478.1, AC004455, AF043644, AI337332, AA236789, AI304319,
AA701988, AA865602, N66532, AI631687.1, AA916723, AA024685, AA916358, AI336121, N23163, AA007455,
AI167263, AA451907, AI283104, AA995467, AA505618, AA913049, AI073755.1, AI538205.1, AA670386, AI352390,
AA680352, AA720562, AA723980, AI081040, AA992256, AI267913, AA532854, R41738, AA928158, AA016221,
AA345744, R72405, AI140745, AI079153, AA852226.1, H89982, AA385531, AI539552, AA236836, N50079, AI090162,
AA858049, AI678739.1, AI678340.1, R77800, AI198148, H30501, AA024784, I26930, AI630424.1, AI630438.1,
N32746, W58718, AA313566, AA765777, R72404, H25699, AA827898, AA828343, R16194, AA620328, AA731868,
AA807325, AI122832, AA883479, AA906396, AI082866, AI128465, AA443098, AA478302, N22400, R62948,
AI683470.1, T36141, AA382667, AI218567, Z40072, AI028209, AA706681, AA007319, AI022083, W87682, AI131464,
AI624085.1, AA835706, H68927, R33458, AA280829, H02184, R76465, R79700, F03294, AI076924, AA515913,
AI461713, AA637410, AA546383, AI585560.1, AA541923, AA959647, AU024430, AU022981, AA137279, AA607321,
AU024429, AI505865, AA000683, AA165954, AV037726.1, AI462603, AI414233, AA675510, W10638, C80158,
AA396049, AA589236, AI427115, AV044619.2, AU018321, AU042469, AI117767, AU042619, AI599140.1, AA924460,
AA963706, AI007935, AA801012, AI103628, AI232289, AA998746, AI177518, AI599208.1, AA140989, AA140898,
AI229404, AI112065, AI532103, M512758, D75940, AA098741, I23866, E05288, E06690, E03372, A06409.1, A46255.1,
I15824, E13276, I40308, A58268.1, A40116.1, E07277, I34427, I85624, A28104.1, E05467
SEQ ID NO: 79

AI010841, AF045432, AF103726, S78798, AI004935, U48696, AJ010903, Y17148, Z97178, AF039698.1, U66300,
U37573, AF032922.1, U39066, AF027174, AF030515, Z49980, AF033097, AF061786, Y 15421, AJ001103, G29058,
G29060, U65376, AF033565, U34048, U52868, AF147449.1, AF033096, S83098, X99051, U44386, AF079586, X65215,
X99055, X80164, S65683, 565686, S65693, S65694, AJ223292, X65335.1, X99568, X70958, 583538, M24488, X64409,
M22135, AF027126, X65320.1, M80484, W73086, AA307154, W58564, AA363862, T06444, AA452335, H78479,

TABLE 1-continued

Sequence homologies (GenBank Accession Numbers)

R63123, T36308, F11379, H59799, W15560, N76641, T83390, F07471, T83556, N24488, H17884, AA293188, AI541284,
T10785, AA157103, W01696, N89520, H58760, N88782, N83991, AA247964, N83168, N83992, N84048, AA247827,
N88601, AA096046, N84855, N84718, N83993, H96310, AA095359, N84712, AA471338, N86694, W23637, N84830,
AA096066, AA093224, AA095641, N55698, R84921, N83229, AA093861, N88518, N87989, N88018, AA249712,
AA089553, N87898, N56555, N84829, AA215908, N88496, AA095435, N84828, AA247965, N84781, AA093897,
N56118, AA093577, AA092086, N89307, N84016, N84721, AA096061, AA249353, N55721, AA089554, AA094237,
N84602, N84723, N84733, W14808, AA124189, AA423088, AA086801, M121283, AA119742, AA222785, AA985756,
AA218282, AA711181, W33933, AA815685, AA273544, AA238334, AA000754, W90901, AI316625, W85535, W36243,
AI595622.1, AA050409, AA106608, AA217769, AI119458, AA390040, AA879757, AA879644, W57189, AA220693,
AA120515, AA623076, AA939357, W16243, AA914937, AA009010, AA674174, AA536703, W76881, AA667299,
AA048263, AA066010, AA117786, AA561056, AA172553, AA177257, AA929573, W16154, AA198255, AA833367,
AA822615, AA140412, AA049167, AA545088, AI561434.1, AA212687, AA222090, AA867450, AF093453, C82658.1,
C83514.1, AF041408, AI483326.1, AI483209.1, AI354060, AJ241143.1, AI617228.1, AI483218.1, M353694, AI353169,
AI618568.1, AI618635.1, AI353159, AI617214.1, AI617432.1, AI616808.1, AI616416.1, AI616967.1, AA933116,
AI617405.1, AA866363, AI353413, AI353166, AA933363, AA660164, AI483120.1, AI483354.1, AI353794, AU061862.1,
AA660165, H07848, AU061924.1, AU061949.1, AU062120.1, AU062001.1, AU062063.1, AU061975.1, AT000691,
AU001522, AU001536, AU061926.1, AU012213, C93682, AU061971.1, A04374.1, I17659, A27635.1, E08429, I15717,
A08586.1, E08428, A22739.1, AR007512, I24104, A22738.1, A29289.1, A25918.1, I24105, A23903.1, E12434, AI1323.1,
A21230.1, E08430, E04616, I28830, A34041.1
SEQ ID NO: 80

AJ010841, AC005666, AC005393, AC005972, AC004099, AC002472.2, AC004381, AC004950.2, AL009031, AC002326,
AC005899, AC005844.7, AC005216, AC007406.1, AC005684, L77570, AC003687, AC005509, AC005516, AC004601,
AC004461, Z49154, AL022159, AC002420, AL021327, AC005297, Z99128, U73643, AC005726, AC007025.2,
AC004812, AC005034, U91323, AJ011930, AC004677, AC005332, AP000019.2, AC002036, AC006111, U07000,
M31758, AC004033.3, L02935, AC005921.2, AC006116, AC005409.1, AC004861, Z95326, AL034427, AL020997,
AC004496, AC002303, Z81364, AC004525, AC002070, AC004584, AF044083, AC007228.1, AFt 11168, AC005668,
AI074462, H99205, AI038375, AA299728, AA732982, AA602488, AI345497.1, AA570441, AI371278, AA487512,
AA491864, AA614595, H70245, F25696.1, AA602468, AA618392, AA306530, AA618346, H66503, AI610602.1,
AI370302, AI285709, AA620386, AA708669, AA362670, M77904, AA338281, AI375374, AA515254, C87864,
AA501262, AI503861, W62377, AI174175, AI425687, W51648, AI430519, AA608054, AU043654, AA125170,
AU019533, AU018489, AI042727, AA606504, W82457, AI413410, AI272569, AI666697.1, AI464637, AI503850,
AI326216, AI604686.1, AA409116, AA546569, AA764359, AA414514, AI536524, AA245852, AA516955, AA675385,
AA647434, AI506364, AU015379, AA501128, AI648194.1, AI585444.1, AA815851, AA435259, W77222, AA521969,
AI066909, AI353956, AA107123, H39328, H39389, AI228245, AA550283, AI151560, AI218793, AI145414, W06387,
I139351, AI601645.1, AI626190.1, AI235890, AI437130, AI411411, AA944647, AA817940, AI234683, AA753253,
AI044039, AI010110, AA751823, AR020909, AR003505, I74786, I16884, A67424.1, I09371, I59642, I55948, I76960,
A42329.1, I45974, AR007159, I81226, AR007160, A52294.1, A62731.1, A47886.1, I17291, AI2032.1, I08101, I08711,
A65971.1, I38533, E12183, I19138, I22241, I73182, I28360, I22254, AR014241, I40899, I96182, A51135.1, AR008154,
I40904, A51133.1, I41409, I34189, I08667, A62791.1, I73181, A62929.1, A47885.1, A28928.1, I25678, AR016035,
I40908, I93602.131750, E03829, I07993, I71461, A58884.1, E03350
SEQ ID NO: 81

AF039218, AF086824, U39904, AF070066, AC004811.2, AC002563, U48696, Z97178, U39066, AF039698.1,
AF032922.1, AF033097, S78798, Y17148, AF103726, AJ004935, AF045432, U66300, AJ010903, U37573, AF027174,
Z49980, AJ001103, U34048, AF061786, AF030515, AF147449.1, G29060, G29058, Y15421, X99051, AF033565,
U65376, S83098, U52868, AF033096, AF079586, X65215, X99055, N80164, U44386, AL022326, S65693, S65694,
S65683, S65686, L09233, AJ223292, AC005088.2, AF030453, Z75543, X70958, X65624, M22135, AF027126,
AF092090, M22462, X59046, X99568, X64409, M24488, X65320.1, X65335.1, S83538, M80484, AC000378, AF063424,
N88018, AA095435, N83992, N83168, AA095359, N84855, AA095641, N83991, AA249712, AA096066, N88782,
N84718, N83229, AA247964, N88601, AA096046, N89520, H58760, N84781, AA092086, AA093577, AA247827,
N84048, N55721, N86694, N55698, N84712, AA471338, N83993, AA249353, AA096061, AA249323, N87898,
N88518, N84765, N87989, N84829, AA093861, N89307, N84740, AA089553, AA093313, N88496, AA215908, N84828,
N56555, AA093897, AA093219, AA095511, N56118, N86439, AA095475, AA090302, AA095473, AA096013, N84016,
AA089554, AA095921, AA247965, AA247828, N84562, N84921, AA215911, N84723, N84575, AA247800, N86441,
N84602, N84733, N85031, AA094237, AA093340, N56179, N84721, N55768, N84716, N84859, N84561, N55681,
N55684, N55700, N84662, AA093327, N84875, N84743, N84874, AA095934, AA095931, N84920, N84764, N55669,
N84719, N84797, AA249317, AA096034, AA249323, N55641, N84759, N84731, N55697, N84734, N84557, N84735,
N84767, N84796, AA968035, AI510359, AA107365, AA177241, AA116487, W62286, AA048139, AI662626.1,
AI510013, AF093453, AI414276, AA793624, AI426165, AF041408, AI241143.1, AI483326.1, AI354060,
AI353169, AI617228.1, AI353694, AI483218.1, AI618635.1, AA660164, M618568.1, AI353159, AI617432.1,
AI617214.1, AA933363, AI616967.1, AA140828, AA660165, T18197, AI616808.1, AA933116, AI616416.1, AU065197.1,
H34782, AA202074, AI171924, C2274, I17659, A27635.1, A04374.1, A29286.1, A71440.1, AI1323.1, I83451, I83450,
E12434, AR018093, AR018092, I75052, I05558, AR013726, A37287.1, I24703
SEQ ID NO: 82

AB023166.1, AC002563, U93872, AL031684.11, U75698, AL034404, D26124, AC004506, AF042091, L32592, S68330,
U05855, X58358, M86609, S68290, M33376, U05684.1, H10788, AA308642, N57796, I91324, W42440, N57810,
R50756, R44891, H79564, H63135, AA353105, AA224531, AI245941, AA778789, AA379967, AA677294, AA617920,
AI183534, AI017868, T64355, N78070, AA349149, F06821, N95101, T18490, AA426495, H64052, H45786, W00508,
AA443253, AI337047, AA456531, AA546601, W78614, AA822334, AI509701, AA177442, AA881661, AA104861,
AA957183, AI228556, AI102448, AA955912, AA753307, I32609, I32608, I09500, I81152
SEQ ID NO: 83

Z36816, X8232Z AB018295, 250112, U91320, Z82205, Y13095, AC004738, Z78419, L14020, X54660, Y14051,
AC004830, L14017, Y13096, X63598, AA088822, H50443, T65364, AA112796, F11994, R11879, AA075824, AA363903,
H19785, T65515, R55598, F11904, AA742633, T08516, T16871, W21846, AA053446, Z45691, F08352, AA018126,

TABLE 1-continued

Sequence homologies (GenBank Accession Numbers)

R09436, N91137, AI371352, R45445, AA707531, AA922035, R16064, H10898, AI522333.1, AA317592, AI042452,
AI280625, AI679950.1, AA995402, AI475240.1, I29160, AA156317, AI282699, AA620367, AI570366.1, AI677936.1,
AA868180, AA024629, AI625587.1, AA896188, AI197257, AI591958.1, W85360, AA517314, AA184178, D28616,
AA000364, AA739011, AI153477, D21680, AA032616, AA027649, AA895817, D77943, AI195080, AI410833,
AA965117, AA264673, E01143, I05978, I07630, I09160, I08646, A00367.1, I83400, E01141, A47497.1, I08512,
A47505.1, I05982, A00368.1, I04859, A47500.1, E01817, I08375, E02975, E01142, I08513, A37282.1, E02287, I95525,
I32037, I32039, I50038, E03805, A09701.1, I32036, I40899, I32038, I32035, A68194.1, I01424, I65799, I40900, I50036
SEQ ID NO: 84

Z36816, AC006075, Z54328.1, Z83849, X82322, Z50112, Z82205, AB018295, AC003034, U91320, Z93242, Y11769,
Y13095, AE000895, U89337, AC004738, L14020, X63598, X54660, Y13096, AC005940, Y14051, L14017, H50443,
AA088822, T65364, AA112796, F11994, R11879, AA075824, T65515, AA363903, R55598, H19785, F11904, AA742633,
T08516, T16871, F08352, Z45691, AA018126, W21846, AA053446, AI254622, T3181.1, R45445, AA707531, N91137,
AI371352, AA922035, H10898, AI341327, AI522333.1, AA317592, R16064, AA896188, AI197257, AA517314, W85360,
AI591958.1, AA184178, D28616, AA000364, D21680, AA739011, AI153477, AA032616, AA027649, AA895817,
AI592661.1, AA184644, AA275926, AI508824, AI195080, AI410833, AI397934, AI329440, AA264673, AI328274,
AI330046, AU014161, I08646, I05978, E02287, A00367.1, A00368.1, E01817, A37282.1, I08513, E01143, I07630,
I08375, A47500.1, A47497.1, I05982, A47505.1, E02975, E01142, I09160, I83400, I04859, I08512, E01141, I95525,
I00302
SEQ ID NO: 85

AF035296, Z70685, AF038149, Z73987, X55146, AI433239.1, AI017541, M143057, AI129967, AI084109, AA629401,
AI032340, AA775878, AA134114, AA088684, AI537873.1, AA709474, AA052969, T17399, AI198524, AA455953,
AA662286, T65434, N23103, AI500354.1, I77285, R48306, T87060, T16870, AA242771, AA364661, AA725410,
AA888835, R48408, R55361, AI383126, AA772585, R17756, R53154, AI468078.1, T83615, AA740428, AA989632,
AA776777, AA970686, F09551, R84473, AA053446, R40543, AA242901, W21846, AA485133, AA281393, AA232269,
AI370430, AA224090, AA384756, R41107, W05481, AA275082, AA855630, AA220284, AI463984, AA463077, W82555,
AA073785, AI324193, AA154075, AI182915, AA106802, AA014261, AI639626.1, AI152571, AA646606, AI506180,
AI507257, AI429182, AI606877.1, AA924764, C47439, C39222, C59098, C50045, C41623, R62041, C08663, AU003527,
A58088.1, I53742, I09510, E07649, I09483, I53740, I09479, I58691, A47294.1, AI4416.1, I43649, I43650,
SEQ ID NO: 86

AB009048, AB025608.1, AB023029, D45408, U66525, AJ001535, AB008265, U92032, U64851, AF040653, AL031466,
AJ001088, AE001119, U28760, AL022159, Z66567, AA911802, AI002480, AI194910, AI553588.1, AA002743,
AI605067.1, AI507141, AV047448.2, AA144114, AI048158, AA027393, AV045119.2, AI616016.1, AI593489.1,
AI114364, AI103519, AF072311, AI104101, AI043643, AI172153, AI170369, AA850229, AA963983, AA943102,
AA964030, AI178450, AI180267, AI444084, AI670492.1, AA866229, AI102852, AA997446, AA819921, E03424,
E01085, I38466, I57017, I50752, I28766, A52373.1, AR00261.1
SEQ ID NO: 87

AC006014.2, AL021492, AB006703, AL021407, U69552, AC004705, AL035652.5, M86602, AC007451.1, AF003389,
U66404, M87645, AB018302, AB008894, DI0388, AL031986.1, AF107885, AF100306, M81324, U67494, U71250,
AC004848, U09099, AI652638.1, AA505930, AA991355, AI141264, AA404284, AA256257, T81922, Z44433,
AA418204, H11780, AA906203, R13493, AA626308, R21616, AA627829, H67699, N72268, AA483210, AA705542,
AA836379, AA399099, T06701, H99959, AA886062, AI498087.1, AI129945, R22315, N78414, AA113241, AI124535,
H58271, AI643503.1, AA445695, AA673655, AA104978, AV034590.1, AI551985.1, AA142747, AI046551, AI020135,
AI603873.1, AV035454.1, AA560196, AV037887.1, AV034119.1, AA522204, AV034487.1, AI594423.1, AI467549,
AA615061, AA536264, AA391903, AA536375, AI545190, AI394892, AA497287, AA852029, AI179945, AI621492.1,
AA141341, AI395360, AU030825, C62664, AA894271, C61515, AI544602, AI484773.1, AI544587, H32027, AI601838.1,
AA392665, AA494567, C61354, AI138116, AU002819, AI6299.1, AR023861, I58691, I85760, A63216.1, A64062.1,
I62852, I78753, A22884.1, A22882.1, A68351.1, A22732.1, I65400, I60419, I96204, I24761, AR023856, I25974,
A68348.1, I09386
SEQ ID NO: 88

AF116910.1, AF033097, AF103726, U48696, AF027174, AF045432, S78798, U39066, U37573, AF032922.1, U66300,
AF039698.1, AJ010903, AJ004935, Y17148, Z97178, Z49980, AF030515, AJ001103, AF061786, U34048, AF147449.1,
G29058, G29060, Y15421, U65376, 583098, AF033565, U52868, X99051, AF033096, L22858, I23180.1, X99055,
X71415, Z83744, U44386, AF079586, I25905, AB025632.1, X78287, Y14344, X65215, AA460045, AA093577, N84781,
AA095641, AA247827, N84830, H58760, N88782, AA095359, N84048, N86694, N84712, N84718, AI681138.1,
AA263076, AI678836.1, R66162, N84892, R59232, AA722287, AA543176, AA153374, AA144562, AA114761,
AA549506, AA623764, AA797275, AA199399, AA461807, AI035692, AI267040, AV009982.1, AA982653, H34369,
AF041408, AI241143.1, AI483326.1, AI483209.1, AI354060, AI353169, AI353694, AI617228.1, AI618635.1,
AI618568.1, AI353159, AI483218.1, AI617214.1, AA933363, AI617432.1, AI616967.1, C72137, AI616808.1, C84814,
AI616416.1, AA739596, A48542.1, AR014186, E02819, I07068, I12528
SEQ ID NO: 89

AF116910.1, AF060568, AF016679, X52871, U51999, M15387, AF099810, U96131, AE000092, AL035427.17, D87952,
AF088189, AC006216, AA827562, AA514488, AI190270, AI539185.1, AA778031, AA083889, AA255533, AI539830.1,
AA532881, AA459956, F19104.2, AA749416, AA247961, N66268, AI630888.1, AA255505, AA384265, AA364111,
AA729375, AA702934, T06791, AI673094.1, AA559086, AA331632, H87048, AA876414, D62684, AA203356,
AU042596, AA271691, AA538198, AV008608.1, AA711797, AI159057, AA120508, AA739069, AV038838.1, U94841,
AA461807, AA473595, AA638281, AA986879, AI480637, AI414420, AI430403, AU051497, AA051596, W87242,
AA823028, AV008133.1, AI035697, AV017984.1, AI415137, AA624777, AI552865.1, AI502808, AI105163, AI562292.1,
N95975, AI548884, N95979, C96694, C98306, AA851073, AA925886, N96596, AI549483, AU029673, D15864,
AI172584, AI500902, I07993, A04710.1, A00782.1, A08458.1, I95863, I36871, I68732, A56817.1, E13740, A29289.1,
A60983.1, E12854, A52326.1, A49428.1, AI1245.1, I13349, A20701.1, AI3038.1, AI0361.1, A49702.1, I19517,
A22413.1, I86202, A49696.1, A49695.1, A25856.1, I12245, AI8755.1, AI4595.1, A02741.1, A08457.1, I40851

TABLE 1-continued

Sequence homologies (GenBank Accession Numbers)

SEQ ID NO: 90

AL031135, M63234, AF033097, AJ004935, U66300, Y15421, U52868, AF045432, Z97178, AF032922.1, AF033096,
AF033565, AF039698.1, U65376, AF027174, U39066, U37573, 578798, U48696, AF03O515, AJ010903, AF103726,
Z49980, S83098, Y17148, AF061786, U44386, AC005868, X98048, U07163, Z29667, D10606, M84660, AC002392,
AL049662.1, L34028, AF015463, AB011474, AF104414, L34027, U45981, Z73565, AJ001103, AE001409, 546763,
M74445, Z68136, AF030694, AL034558.2, Z70720, AL021749, U67476, H53674, N55768, N84921, N86439, AA096061,
N84859, N55711, AA093577, AA247828, AA093219, AA090302, N84575, AA249323, N55657, N84767, N84825,
N55724, AA249356, AI594372.1, AA592233, M647320.1, AA123399, AJ241143.1, AI353159, AI618635.1, AI353169,
AF041408, AI617228.1, AI353694, AI354060, AI618568.1, AI617432.1, AA933363, AI616967.1, H36649, AI617214.1,
T18143, AI616416.1, I17764, I17765, A43593.1, A43592.1, AR008277, I24903, AR008281, I23472, AI8007.1, A38773.1,
I38469, I43367, I24890, A38056.1, A71624.1, I44515, I44520, I25434, A63985.1, AR007269, AR016568, AR016569,
I92757, I24891.I44509, I64576, AR007125

SEQ ID NO: 91

AC002038, AC006548.19, AF130247, AC000056, AP000010.2, AL031665.18, AC005215, U82672, Z92545, AC002458,
AC006461.2, AC007057.3, Z95118, AC004982, Z99774, AC004413, AA114131, H78605, H78687, R82153, AI282999,
AA653319, N63471, AI340635, AA969018, AA923386, AA824410, AA551674, AI050003, AI301848, AI638856.1,
AA853953, AI638318.1, AA432277, AA431270, R24442, AI681095.1, M278431, AI190698, N50472, AA319938,
N91422, I77772, AV003543.1, AA389188, AA919609, AA592159, AA899612, AA898213, AI083431, I46963, I09348,
I96215, I09211, A51521.1, I08117, I43652, AR012060, I22507, I34294, A37262.1, E12183, E03829, I25849, I96182,
AR020909, A52294.1, I59642, I76960, A58551.1, AR007159, A43445.1, AR007160, I38891, I73246, A51133.1, I51997,
I73182, AR014241, AR003505, A51135.1, I01958, A67988.1, I40899

SEQ ID NO: 92

AF150755.1, U67205, U67203, U67204, D13637, R78273, AI290663, AA297912, AA451993, AA302993, AI583168.1,
H23080, AA178091, AA288614, AI504039, AA274809, W08027, W91036, AI413912, AA501231, AI429716, AI403713,
AI238618, E03581, AI6434.1, I70539, I87453

SEQ ID NO: 93

U67205, U67203, AF150755.1, U67204, AC006299, L08471, AL031599, U27560, AC005670, AC000I11, Z99112,
U51998, AC006971.2, Z35640, AP000102.1, AB013389, AF071085, U30274, AC005137, L41269, U73396, X97233,
AB010073, X94262, AF001881, AF103010, L76661, X97232, AF103011, AF103013, L76664, AF022044, Z21839,
AA418046, AA393617, AA132249, W05478, W15464, 99842, AI383511.1, M334080, AI225232, AI140733, AA552429,
AI283044, AI269423, AI040542, AA813739, H90905, R14965, AI625631.1, AI383549, AA635490, AA256953, R50731,
R27065, AI423682.1, AI248354, AA931236, AA737658, AA460634, R05339, AA829968, AA948123, AA777893,
AA771745, AA769443, AA419127, AA361925, AA053786, H56090, R73015, R23185, AI631246.1, AI431288, AI097636,
AA996225, AA878520, AA642284, AA621004, AA533878, R00269, AI422127.1, AI312823, AI025575, AA716080,
AA613143, AA534584, AA419180, R48247, AI460341, AI460324, AI423007.1, AI375614, AI357646, AI263030,
AI583151.1, AI421614.1, AI332316, AA960985, AA778125, AA776966, AA758265, AA648970, AA448346, AI587970.1,
AV004416.1, AA666627, AA139382, AA087031, W89875, AI386222, AA175795, AA097956, AI180927, M480941,
AI115201, AI647028.1, AA462479, AA409953, AA153021, W59568, W75289, AA451536, AA020543, AI036133,
AA796164, AA739299, AA003190, W98482, AA832781, AA241888, AA184762, AA14531.1, W64224, W53363,
AA289197, AI595619.1, AI007134, AA253670, AA153027, W47956, C43219, Z29935, AI407349, T41447, AA686495,
AA818516, AA946500, H35570, AI411156, 41484, AU052094.1, AI043927, AA894132, AI169190, AA801169,
AI045952, AA800545, AA801168, AI535064, AR012062, E07319, AR012121, I88853, A27001.1, I18360, AR014185,
A27005.1, I09208, I85809, I73445, I13429, AI9451.1, A65943.1, AR019266, A62673.1, I32320, I30447, A65401.1,
A65962.1

SEQ ID NO: 94

AF147338.1, AF111426, AC007048.3, AC005385, U60334, AF020802, Z83317, AJ229041, Z95889, AC000122, V00291,
K02844, X00794, D16499, Z99753, AL031133, U95742, M10248, AC005249, Z81138, M16221, X52464, AI671570.1,
T58078, T58198, AA918819, AA017211, AA247593, T11529, AA807369, AA084789, AI341118, AA523267, 27488,
AI194841, AV047074.2, AI462153, AV038768.1, AU041720, AV004917.1, AI463222, AV008122.1, AI255467,
AI303531, AA646377, C78401, AA611173, AA960677, C78201, AA289775, AV030316.1, AI550786.1, AI505581,
W91703, AA959869, AI607907.1, AI461822, AA538545, AA423250, AA259531, AA691770, AA423704, AI122141,
W29889, AA734499, AA693177, AA762941, AA451530, AA839637, AI195362, AU030011, AU034860.1, AI009456,
M574942.1, I135669, AU006381, AI227633, AA955096, AI576027.1, AI138176, AA999125, AA924339, AA925033,
AI179414, AI602918.1, AA395171, AA923867, AI577531.1, AI415951, AI031143, AI176215, AI236800, M599936.1,
AI410555, A69663.1, A69662.1, E08631, E03805

SEQ ID NO: 95

AF147338.1, X80821, U60334, AC000122, AC005901, M96441, L28955, AL033377.2, AA918819, T58078, T58198,
AA496039, R68550, R86033, AA652658, AI291783, AI291446, H93102, AI376609.1, AI567672.1, AI351633, R77622,
AA548171, H44377, T11529, AA839637, AI182684, AI122141, AA762941, AA423704, AA451530, W29889, AA691770,
W84193, AI098323, W10598, AA215027, AA764637, AI606411.1, AI006866, AA638627, AA919762, AA839981,
AI046809, AI121151, AA170888, AA145588, AI315950, AI465123, AI225473, AA433507, AA570928, C72277,
AU030011, AI096187, E08631, A45355.1, I07373, AR018795, I38435, I08188, I23879

SEQ ID NO. 96
NGO-Br-37 combined

NM_006644.1, AB003333.1, AF039695.1, AB003334.1, D86956.1, NM_013559.1, D67017.1, D67016.1, L40406.1,
Z47807.1, AB005275.1, AB005282.1, AB005281.1, AB005278.1, AB005276.1, AB005274.1, NM_011020.1, U23921.1,
D49482.1, AB001926.1, NM_014278.1, AB023421.1, L12723.1, AB005279.1, X67643.1, AB005280.1, AF077354.1,
NM_008300.1, AB023420.1, D85904.1, AC011661.5, AL109620.4, L08605.1, AC005851.2, AC011294.3, AI658961.1,
AW571648.1, AW474070.1, AW572452.1, AW470142.1, AW608075.1, AW385582.1, AW577563.1, AW820299.1,
AA232636.1, AI758907.1, AW859988.1, AW859943.1, AW630933.1, AW820234.1, AW604836.1, AW390368.1,

TABLE 1-continued

Sequence homologies (GenBank Accession Numbers)

AW316651.1, AW771360.1, AA166806.1, AW820232.1, H63595.1, AI002886.1, AL042714.2, AI751852.1, AW631423.1, H91211.1, H54656.1, AA334479.1, AI651186.1, AA777031.1, AW628153.1, AI223825.1, AA136424.1, AA953645.1, AI582484.1, AA394027.1, AA714219.1, AA805016.1, AW103624.1, AA580845.1, F07487.1, M288972.1, M337175.1, P08794.1, AI656127.1, AI633338.1, AI203278.1, AI094015.1, AI800379.1, H64073.1, AW389335.1, Z20100.1, AA094644.1, T63090.1, AI799265.1, AA435594.1, AA580712.1, AA105012.1, AI267631.1, AA777564.1, N84915.1, AA485036.1, AA311379.1, AW206874.1, W86141.1, AA571359.1, AA885873.1, N84914.1, AI290252.1, AA624532.1, Z21219.1, AA811573.1, AW609781.1, AI838486.1, AW020035.1, AW210124.1, AI702970.1, T34627.1, Z21220.1 C81194.1, H63551.1, X85639.1, AW238563.1, H64019.1, AW085874.1, AA278231.1, AA580595.1, H91160.1, AA572403.1, H54657.1, AA571473.1, AA843693.1, AW391561.1, Z41841.1, AA417317.1, W45471.1, AW362751.1, AA867489.1, AA749004.1, AL137142.8, AC015501.3, AC021286.3, AC020834.2, AC044841.2, AC023471.2, AC016715.2, AC018818.3, AL138763.2, AC021531.3, AC005506.6, AC018789.2, AC034468.1, AL162502.2, AL034557.7
SEQ ID NO. 97
NGO-Br-37
MK136/T7 3'

NM_006644.1, AF039695.1, AB003334.1, AB003333.1, D86956.1, I47807.1, D67017.1, D67016.1, NM_013559.1, L40406.1, AB005282.1, AB005281.1, AC005371.1, AL163279.2, AE003720.1, AE003562.1, AC006548.20, AC006160.9, AF016672.2, AC005951.1, AC004251.1, AL163234.2, Z92838.1, Z83109.1, Z79753.1, Z71259.1, Z83827.1, AL035258.10, AP001689.1, AP000477.2, AW571648.1, AW572452.1, AW474070.1, AI658961.1, AW470142.1, AW385582.1, AW316651.1, AW608075.1, AA232636.1, AW771160.1, AA166806.1, AA136424.1, AI651186.1, AI223825.1, AI751852.1, AA394027.1, AA435594.1, AI337175.1, AI582484.1, AW628153.1, AW103624.1, AA953645.1, AA485036.1, AI288972.1, AW820299.1, AW390368.1, AI799265.1, Z20100.1, AW085874.1, AW604836.1, AA417317.1, AW609781.1, AW020035.1, AI838486.1, C81194.1, AA624532.1, AA571359.1, AA079853.1, T34627.1, Z21220.1, AA843693.1, AA571473.1, AA572403.1, F07487.1, AA278231.1, F08794.1, T63090.1, AW859988.1, AW859943.1, AW820234.1, AW491178.1, AI842560.1, AV275994.1, AA967441.1, AA856248.1, I41841.1, AW820232.1, AW389335.1, AA777031.1, AA238818.1, AV347805.1, AI970469.1, AV178670.1, AV141053.1, AI365340.1, AI341168.1, AI115351.1, C56104.1, C55163.1, C54236.1, C54007.1, D64277.1, T26732.1, D33807.1, AL137142.8, AC008689.4, AC010785.3, AC016715.2, AC011743.3, AF129408.1, AC025243.3, AC027399.2, AC026927.2, AC012569.3, AC005506.6, AC009039.5, AC007337.2, AC008361.7, AC021326.1, AC014468.1, AF176680.1, AP001895.1, AP001563.1, AC055800.2, AC027502.3, AC044830.2, AC034128.2, AC008155.6, AC016926.4, AC027359.2, AC027002.2, AC027057.2, AC026650.3, AC020991.3, AC009925.3, AC018954.4, AC024681.2, AC016306.3, AC016997.4, AC019032.3, AC021188.2, AC013110.1, AL109916.3, AL162264.4, AL161653.7, AL138705.3, AL161738.4, AL158817.2, AL138694.5, AL137247.3, AP001803.1, Z98863.1,
SEQ ID NO. 98
NGO-Br-37
MK151/T7 3'

NM_006644.1, AF039695.1, AB003334.1, AB003333.1, D86956.1, U67017.1, D67016.1, NM_013559.1, L40406.1, Z47807.1, AB005282.1, AB005281.1, AB023420.1, X67643.1, AE003589.1, AC005762.1, AC000119.1, AE003522.1, AE003473.1, AC009223.2, AF030511.1, AF067211.2, AC005951.1, U22892.1, U84144.1, AC002312.1, AX002407.1, X04465.1, AL034582.11, U77302.1, AL078599.19, AL009183.10, Z74617.1, AL035258.10, X16094.1, M36578.1, L08612.1, X01647.1, AB018706.1, G21718.1, G38495.1, 058719.1, AL144420.1, 003936.1, G27119.1,022600.1, AL149482.1, AU48977.1, AL145762.1, Z94707.1, AL022449.1, G28140.1, G27716.1, 025125.1, G24942.1, L30947.1, G60761.1, 050693.1,048927.1,062261.1,041307.1, AF052368.1, 028922.1, G19992.1, 016172.1, G12990.1, G36232.1, G35802.1, AL158374.1, AL153532.1, AL153227.1, AL151189.1, AL150403.1, AL148989.1, AL147211.1, AL143371.1, G06747.1,006621.1, 005724.1, AJ229990.1, Z54069.1, Z67861.1, Z66769.1, Z32058.1, AL137142.8, AC012569.3, AP001895.1, AP001563.1, AC027117.2, AC022671.2, AC015904.3, AC025383.2, AC022797.3, AC020725.3, AC021722.4, AC009039.5, AC007337.2, AC023309.1, AC017242.1, AL353894.3, AL162502.2, AC032034.2, AC008902.3, AC008689.4, AC034128.2, AC027057.2, AC025220.2, AC010912.3, AC017150.1, AL137247.3, AL031745.7,
SEQ ID NO. 99
NGO-Br-37
MK212/T3 5'

NM_006644.1, AB003333.1, AF039695.1, AB003334.1, D86956.1, NM_013559.1, D67017.1, D67016.1, L40406.1, Z47807.1, AB005275.1, AB005276.1, AB005278.1, AB005274.1, AF077354.1, NM_008300.1, D85904.1, NM_011020.1, U23921.1, D49482.1, AB001926.1, AB023420.1, X67643.1, AC005851.2, AC010852.5, AC003099.1, AP001821.1, AC024813.1, AC004668.1, NM_005742.1, AC004879.1, AC005870.2, AC006518.17, IJ73002.1, AF004739.1, U41009.1, D49489.1, AJ002201.1, AB023039.1, L16771.1, X67814.1, AW577563.1, AW630933.1, AI758907.1, I163595.1, AI002886.1, AL042714.2, AW631423.1, H91211.1, H54656.1, AA334479.1, AA714219.1, AA805016.1, AA580845.1, AI656127.1, AI633338.1, AI203278.1, AI094015.1, AI800379.1, H64073.1, AA094644.1, AA580712.1, AA105012.1, AI267631.1, AA777564.1, N84915.1, AA311379.1, AW206874.1, W86141.1, AA885873.1, N84914.1, AI290252.1, Z21219.1, AA811573.1, AW210124.1, M702970.1, X85639.1, AW238563.1, H63551.1, H64019.1, AA580595.1, H91160.1, H54657.1, W45471.1, AA867489.1, AA777031.1, AA749004.1, W86085.1, AA108277.1, AA555929.1, AA555921.1, AW820231.1, AW820224.1, AW391572.1, AW362766.1, AW820299.1, AW859988.1, AW859943.1, AW820234.1, AW820232.1, AW604836.1, AW391561.1, AW362751.1, AW229772.1, AI956648.1, AA870633.1, AA821679.1, AA543642.1, AA518224.1, AA437859.1, AA125191.1, AA103602.1, AW582504.1, AW609867.1, AW817504.1, AW817496.1, AW817440.1, AW817432.1, AW817364.1, AW817315.1, AW817234.1, AW817219.1, AW817153.1, AW609859.1, AW609842.1, AW609816.1, AW609809.1, AW609784.1, AW582499.1, AW391901.1, AW391888.1, AW381775.1, AW372095.1, AW371570.1, AW371556.1, AW371552.1, AW371548.1, AW371546.1, AL135032.1, AI907727.1, AA191559.1, AL137142.8, AC024112.9, AC027009.2, AC009290.2, AC021255.2, AC020834.2, AC044841.2, AC068895.1, AL354918.3, AL138763.2, AL049812.13, AP000886.1, AC058786.7, AC027238.2, AC013545.2, AL159973.2, AP001863.1,

TABLE 1-continued

Sequence homologies (GenBank Accession Numbers)

SEQ ID NO. 100
NGO-Br-37
MK212/T7 3'

NM_006644.1, AF039695.1, AB003334.1, AB003333.1, D86956.1, D67017.1, D67016.1, NM_013559.1, L40406.1,
Z47807.1, AB005282.1, AB005281.1, AC005215.1, AL163279.2, AP193508.1, AC006080.1, AC009223.2, AF016672.2,
U22892.1, AL161539.2, Z98981.2, X04465.1, Z92838.1, Z83109.1, AL035258.10, AB042297.1, Z97336.1, L08612.1,
X01647.1, AI658961.1, AW571648.1, AW474070.1, AW572452.1, AW608075.1, AW385582.1, AW470142.1,
AW316651.1, AA232636.1, AA166806.1, AI751852.1, AW771160.1, AW628153.1, AW820299.1, AA953645.1,
AI337175.1, AI651186.1, AA394027.1, AW390368.1, AA136424.1, AI223825.1, AW604836.1, AA435594.1, AI582484.1,
AW103624.1, AA455 036.1, AI288972.1, AA624532.1, AA571359.1, F07487.1, AW859988.1, AW859943.1, Z20100.1,
F08794.1, AW820234.1, AW085874.1, M799265.1, T63090.1, AA572403.1, AW609781.1, AI838486.1, AA571473.1,
AW820232.1, C81194.1, AA417317.1, AW020035.1, AW389335.1, AA079853.1, T34627.1, AA777031.1, Z21220.1,
AW491178.1, AI842560.1, AA843693.1, AV275994.1, AA278231.1, AA967441.1, AA856248.1, Z41841.1, AA238818.1,
AI115351.1, AV347805.1, AW147250.1, AV348434.1, AV200611.1, AV151186.1, AV178670.1, AV059415.1,
AU055867.1, AI365340.1, M341168.1, AA882330.1, C78586.1, C56104.1, C55163.1, C54236.1, C54007.1, C34122.1,
C31088.1, AA522360.1, C12303.1, D64277.1, R98128.1, T26732.1, D33807.1, AL137142.8, AC012569.3, AP001895.1,
AP001563.1, AC027128.3, AC023471.2, AF129408.1, AC021710.4, AC020725.3, AC009039.5, AC007337.2,
AC008361.7, AC014468.1, AC026863.3, AC032034.2, AC008902.3, AC027359.2, AC026650.3, AC019267.3,
AC024681.2, AC022776.2, AC018519.3, AL109916.3, AL162264.4, AL138705.3, AL158817.2,
SEQ ID NO. 101
NGO-Br-37
MK379/T7 3'

NM_006644.1, AF039695.1, AB003334.1, AB003333.1, D86956.1, D67017.1, D67016.1, NM_013559.1, L40406.1,
Z47807.1, AB005281.1, AB005282.1, AC005371.1, AB005280.1, AC009223.2, AC005951.1, Z79754.1, AL009183.10,
Z74617.1, AL035258.10, AW571648.1, AI658961.1, AW572452.1, AW474070.1, AW385582.1, AW608075.1,
AW470142.1, AW316651.1, AA232636.1, AA166806.1, AI751852.1, AW771160.1, AW628153.1, AA394027.1,
AA953645.1, AI651186.1, AA136424.1, AW103624.1, AW820299.1, AI223825.1, AI582484.1, AI337175.1,
AW390368.1, AA435594.1, AA485036.1, AI288972.1, AW604836.1, Z20100.1, AI799265.1, AW609781.1, P08794.1,
F07487.1, AW859988.1, AW859943.1, AW085874.1, T63090.1, AW820234.1, AA624532.1, AA571359.1, AA417317.1,
AA572403.1, AW020035.1, AI838486.1, AA571473.1, T34627.1, Z21220.1, C81194.1, AW820232.1, AA079853.1,
AA278231.1, AA843693.1, AW491178.1, AI842560.1, AA967441.1, AA856248.1, AV275994.1, Z41841.1, AW389335.1,
AA238818.1, AA524050.1, AW670042.1, AW467587.1, AW440906.1, AW301952.1, AV347805.1, AW148805.1,
AW080765.1, AW073417.1, AW021546.1, AW006027.1, AI870113.1, AI766462.1, AI699756.1, AI680535.1, AI563975.1,
AI510837.1, AI378898.1, AI378423.1, AI290741.1, AI288939.1, AI092211.1, AA987850.1, AA877634.1, AA806917.1,
AA745943.1, AA725830.1, AA682373.1, AA506124.1, AA465237.1, AA232282.1, AA129977.1, AA035579.1, W58443.1,
N91182.1, T63600.1, AL137142.8, AC012569.3, AP001895.1, AP001563.1, AC008689.4, AC027117.2, AC022671.2,
AC021710.4, AC020725.3, AC009039.5, AC007337.2, AC023309.1, AF176680.1, AL132989.1, AC034128.2,
AC027057.2, AC025225.2, AC024681.2, AC023557.1, AL356059.1, AL139800.1, AP000780.1,
SEQ ID NO. 102
NGO-Br-37
MK394/T7 3'

NM_006644.1, AF039695.1, AB003334.1, AB003333.1, D86956.1, D67017.1, D67016.1, NM_013559.1, L40406.1,
Z47807.1, AB005281.1, AB005282.1, AB023420.1, X67643.1, NM_008300.1, AC005371.1, D85904.1, AC005215.1,
AC011294.3, AE003589.1, AF241729.1, AC005762.1, AC007161.1, AC005539.1, AC005951.1, Z71259.1, Z99289.1,
AL035258.10, Z74739.1, AI658961.1, AW571648.1, AW474070.1, AW608075.1, AW572452.1, AW385582.1,
AW470142.1, AI751852.1, AW316651.1, AA166806.1, AW628153.1, AA232636.1, AA953645.1, AW820299.1,
AW390368.1, AW604836.1, AW771160.1, AA394027.1, AW103624.1, AI651186.1, AA136424.1, AI223825.1,
AI337175.1, AW820234.1, F07487.1, AA485036.1, AW859988.1, AW859943.1, F08794.1, AI582484.1, AA435594.1,
T63090.1, AI288972.1, AW820232.1, AW609781.1, AI799265.1, Z20100.1, AA624532.1, AA571359.1, AW085874.1,
AW389335.1, M838486.1, AA572403.1, C81194.1, AA571473.1, AA417317.1, AW020035.1, AA777031.1, T34627.1,
AA079853.1, Z21220.1, AA278231.1, AA843693.1, AW491178.1, AI842560.1, Z41841.1, AV275994.1, AA967441.1,
AA856248.1, AW861588.1, AW819997.1, AW819755.1, AW604699.1, AW366794.1, AW085727.1, AI925201.1,
AI754819.1, AI567970.1, AA703912.1, AA493400.1, AA173193.1, R54223.1, AW754207.1, AW545353.1, AW545094.1,
AW542227.1, AW537735.1, AW060626.1, AI956869.1, AA823019.1, AA799083.1, AA445826.1, AA238818.1,
AA205597.1, AW604696.1, AS583074.1, AW578928.1, AI626242.1, AA542420.1, AV347805.1, AW619786.1,
AW391561.1, AI806597.1, AV059415.1, AI115351.1, R98128.1, AL137142.8, AC008689.4, AC027399.2, AC026927.2,
AC022212.3, AC023574.2, AC012569.3, AC020725.3, AC009039.5, AC007337.2, AC017242.1, AF176680.1,
AL353894.3, AL353753.1, AL158817.2, AP001895.1, AP001563.1, AC034128.2, AC016926.4, AC024909.8,
AC012135.2, AC017024.4, AC025673.2, AC027057.2, AC022537.3, AC025971.2, AC009925.3, AC024681.2,
AC021571.3, AC021903.5, AC012434.3, AC009969.4, AC021326.1, AC013759.2, AC013493.1, AL121927.18,
AL354749.2, AL136220.2, AL133350.7, AL139800.1, AL031745.7,
SEQ ID NO 103
NGO-Br-37
MK401/T3 5'

NM_006644.1, AF039695.1, AB003334.1, AB003333.1, D86956.1, Z47807.1, D67017.1, D67016.1, NM_013559.1,
L40406.1, NM_011020.1, U23921.1, D49482.1, AB001926.1, NM_0142781, AB023421.1, L12723.1, AB005279.1,
AB005280.1, X67643.1, AF077354.1, NM_008300.1, AB023420.1, D85904.1, AB005281.1, AL109620.4, L08605.1,
AE003589.1, AF161311.1, AF136711.1, AE001434.1, AE003481.1, AC005762.1, AC004045.1, AC006403.3,
AE003657.1, AE003645.1, AE003411.1, AC011609.9, AC011662.1, AC006288.1, X94582.1, X94581.1, AB020374.1,
AB020372.1, AB020370.1, AB020368.1, AB020366.1, AB020364.1, AB020362.1, AB020360.1, AB020356.1,
AB020350.1, AB020347.1, AB020345.1, AB020343.1, AC010722.2, AC011299.3, AF169288.1, AC005161.1,
AP198095.1, AF128525.1, Z95559.1, AL109865.36, AL034488.1, AL110490.1, AL117205.2, Z35595.1, AB020876.1,
AW820299.1, AW390368.1, AW859988.1, AW859943.1, AW820234.1, AW604836.1, AW608075.1, AI658961.1,

TABLE 1-continued

Sequence homologies (GenBank Accession Numbers)

AW820232.1, AW628153.1, AI751852.1, AW385582.1, F07487.1, AA777031.1, F08794.1, AA953645.1, AW389335.1,
T63090.1, AA166806.1, AW474070.1, AW571648.1, AA394027.1, AW103624.1, AW609781.1, AA485036.1,
AW572452.1, AW391561.1, AI838486.1, AA571359.1, AW316651.1, AW362751.1, C81194.1, AW470142.1,
AJ397361.1, AA624532.1, AW754210.1, AW583074.1, AI760838.1, AI337175.1, AW819755.1, AW578928.1,
AA212025.1, AU080443.1, AW206874.1, AW125594.1, AA919208.1, AA755774.1, AA645750.1, AA615363.1,
AA445826.1, AA117945.1, AW819997.1, AI626242.1, AI094015.1, W86085.1, AA885873.1, AA626524.1, W22433.1,
H63551.1, T29047.1, AW861588.1, AW604699.1, AW366794.1, AW085727.1, AI925201.1, AI754819.1, AI567970.1,
AU035998.1, AA703912.1, AA493400.1, AA431598.1, AA173193.1, H64019.1, R54223.1, AI758907.1, AW754207.1,
AW545353.1, AW545094.1, AW542227.1, AW537735.1, AW060626.1, AI956869.1, AI702970.1, AA823019.1,
AA799083.1, AA777564.1, AW839103.1, AA555929.1, AA370218.1, AA205597.1, AW604696.1, AA580595.1,
AA542420.1, AW861596.1, AI314009.1, C76500.1, AA549968.1, H91160.1, AL137142.8, AC015501.3, AC021286.3,
AC008642.3, AC006278.6, AC019327.4, AC017242.1, AL034557.7, AC025358.3, AC011333.4, AC027429.2,
AC025673.2, AC027054.2, AC024968.2, AC016459.2, AC021997.2, AC017097.2, AL139034.3, AL157821.1,
SEQ ID NO. 104
NGO-Br-37
MK40/T7 3'

NM_006644.1, AF039695.1, AB003334.1, AB003333.1, D86956.1, D67017.1, D67016.1, NM_013559.1, L40406.1,
Z47807.1, AB005282.1, AB005281.1, D32136.1, AE003798.1, AE003579.1, AF067211.2, AC005926.1, AC005951.1,
U22892.1, AC004429.1, AC002312.1, AL161539.2, X04465.1, AL078599.19, AL009183.10, Z74617.1, AL035258.10,
Z97336.1, X16094.1, M36578.1, L08612.1, X01647.1, AW571648.1, AI658961.1, AW572452.1, AW474070.1,
AW385582.1, AW470142.1, AW608075.1, AW316651.1, AA223636.1, AW771160.1, AI651186.1, AA166806.1,
AA136424.1, AI223825.1, AA435594.1, AI582484.1, AI751852.1, AA394027.1, AI288972.1, AW628153.1, AI337175.1,
AA953645.1, AW103624.1, AI799265.1, Z20100.1, AW820299.1, AW390368.1, AW085874.1, AA485036.1,
AW604836.1, AA624532.1, AA571359.1, AA572403.1, AA417317.1, P07487.1, AA571473.1, F08794.1, AW609781.1,
AW020035.1, AW859988.1, AW859943.1, AW820234.1, T63090.1, T34627.1, AI838486.1, Z21220.1, C81194.1,
AA843693.1, AA278231.1, AA079853.1, AW491178.1, AI842560.1, AV275994.1, AW820232.1, AA967441.1,
AA856248.1, Z41841.1, AA238818.1, AI115351.1, AV347805.1, AW147250.1, AI937768.1, AV200611.1, AV181186.1,
AU055867.1, C34122.1, C31088.1, C12303.1, AL137142.8, AC012569.3, AP001895.1, AP001563.1, AC027117.2,
AC022671.2, AC022071.7, AC021710.4, AC022797.3, AC020725.3, AC021722.4, AC009039.5, AC007337.2,
AC023309.1, A0018789.2, AC063937.2, AC027648.6, AC008158.3, AC026340.2, AC034128.2, AC027730.2,
AC055761.2, AC027057.2, AC022530.4, AC025220.2, AC025973.2, AC025231.2, AC015808.3, AC025225.2,
AC009925.3, AC024681.2, AC022461.3, AC023557.1, AC009969.4, AC015976.3, AC020050.1, AC018258.1,
AC013493.1, AC007420.3, AC004581.1, AL355294.2, AL356059.1, AL158817.2, AL121750.3, AP001803.1,
AL031745.7, AP000780.1,
SEQ ID NO. 105
NGO-Br-37
MK508/T3 5'

NM_006644.1, AF039695.1, AB003334.1, AB003333.1, D86956.1, D67017.1, D67016.1, NM_013559.1, L40406.1,
Z47807.1, AB005282.1, AB005281.1, AB005280.1, AB023420.1, X67643.1, NM_008300.1, D85904.1, AF262041.1,
AC011661.5, AL163279.2, AL109620.4, AC004684.2, AE003720.1, AE003522.1, AF222716.1, AC009223.2,
AC004251.1, AC002367.1, AL163234.2, AL161553.2, AL161539.2, X04465.1, AL139077.2, AL009183.10, AP001689.1,
Z97336.1, AI658961.1, AW571648.1, AW474070.1, AW572452.1, AW470142.1, AW608075.1, AW385582.1,
AA232636.1, AW316651.1, AW771160.1, AA166806.1, AI751852.1, AI651186.1, AI223825.1, AW628153.1,
AA136424.1, AA953645.1, AI582484.1, AA394027.1, AW820299.1, AW390368.1, AW103624.1, AI288972.1,
AI337175.1, AW604836.1, Z20100.1, AI799265.1, AA435594.1, AA485036.1, AA571359.1, P07487.1, F08794.1,
T63090.1, AA624532.1, AW859988.1, AW859943.1, AW609781.1, AI838486.1, AW020035.1, AW820234.1, T34627.1,
Z21220.1, C81194.1, AW085874.1, AA278231.1, AA572403.1, AW820232.1, AA571473.1, AA843693.1, Z41841.1,
AA417317.1, AW389335.1, AA079853.1, AW491178.1, AI842560.1, AV275994.1, AW837156.1, AA967441.1,
AA856248.1, AA777031.1, AW068948.1, F03714.1, AA238818.1, AV146133.1, AI528497.1, AI115351.1, AA462732.1,
AW861588.1, AW819997.1, AW604699.1, AW366794.1, AI925201.1, AV149067.1,
AI754819.1, AI567970.1, AA703912.1, AA493400.1, AA173193.1, R54223.1, AW545353.1, AW545094.1, AW542227.1,
AW537735.1, AW060626.1, AI956869.1, AA823019.1, AA799083.1, AA445826.1, AV160311.1, AI600071.1,
AI236601.1, AA205597.1, AW604696.1, AW700938.1, AI790491.1, AA681295.1, AU053616.1, AL137142.8,
AC012569.3, AP001895.1, AP001563.1, AC023471.2, AC021531.3, AC005506.6, AC021722.4, AC009039.5,
AC007337.2, AC008361.7, AC014468.1, AL162502.2, AC027149.2, AC009634.3, AC019267.3, AC024681.2,
AV006281.6, AC022461.3, AL109916.3, AL138705.3, AL161449.2, Z98863.1,
SEQ ID NO. 106
NGO-Br-37
MK612/T3 5'

NM_006644.1, AP039695.1, AB003334.1, AB003333.1, D86956.1, Z47807.1, D67017.1, D67016.1, NM_013559.1,
L40406.1, AB005281.1, NM_011020.1, U23921.1, D49482.1, AB001926.1, NM_014278.1, AB023421.1, L12723.1,
AB005279.1, X67643.1, AF077354.1, NM_008300.1, AB023420.1, D85904.1, AB005280.1, L08605.1, AE003589.1,
AF161311.1, AF136711.1, AE001434.1, AE001433.1, AC005762.1, AC004045.1, AC006403.3, AC011609.9
AF049895.1, AC006288.1, AC005951.1, AE001393.1, AF068862.1, L04162.1, AB026651.1, L08135.1, L22219.1,
AW820299.1, AW608075.1, AW604836.1, AW390368.1, AI658961.1, AW859988.1, AW859943.1,
AI751852.1, AW820234.1, AW385582.1, AW820232.1, AA953645.1, AA166806.1, AW571648.1, AA394027.1,
AW474070.1, AA777031.1, AW103624.1, F07487.1, AW572452.1, F08794.1, AW389335.1, AA485036.1, T63090.1,
AW316651.1, AW609781.1, AW470142.1, AW391561.1, AI838486.1, AI337175.1, AA571359.1, AW362751.1, C81194.1,
AA624532.1, AA079853.1, AA232636.1, AA572403.1, AA571473.1, AW771160.1, AW754210.1,
AW583074.1, AW206874.1, AI760838.1, AW578928.1, AA21202.5,1, AI094015.1, AA645750.1, W86085.1,
AW819755.1, AA885873.1, AW125594.1, AU080443.1, AA919208.1, AA755774.1, AA615363.1, AA445826.1,
AA117945.1, H63551.1, K64019.1, AI758907.1, AI702970.1, AA777564.1, AW819997.1, AA626524.1, AA580595.1,
W22433.1, H91160.1, T29047.1, AW861588.1, AW839103.1, AW604699.1, AW366794.1, AW085727.1, AI925201.1,
AI754819.1, AI626242.1, AI567970.1, AU035998.1, AA703912.1, AA493400.1, AA370218.1, AA173193.1, H54657.1,

TABLE 1-continued

Sequence homologies (GenBank Accession Numbers)

R54223.1, AW754207.1, AW545353.1, AW545094.1, AW542227.1, AW537735.1, AW060626.1, AI956869.1,
AI314009.1, AA823019.1, AA799083.1, AA555929.1, AA205597.1, AW604696.1, AA542420.1, AL137142.8,
AC015501.3, AC021286.3, AC008642.3, AC023574.2, AC006279.6, AC006278.6, AC019327.4, AC009039.5,
AC007337.2, AC017242.1, AL353894.3, AL353753.1, AL034557.7, AC055800.2, AC037481.2, AC024891.8,
AC026825.2, AC025358.3, AC011333.4, AC008714.2, AC034128.2, AC024909.8, AC015533.4, AC027429.2,
AC016805.3, AC009786.2, AC027057.2, AC027054.2, AC025538.3, AC024968.2, AC024681.2, AC016459.2,
AC020712.4, AC021903.5, AC022758.3, AC021997.2, AC017097.2, AC022725.1, AC009728.2, AL353714.2,
AL138705.3, AL355483.1, AL355135.1, AL353630.1, AC002421.1, AL157821.1, AL138920.2, AL137247.3,
SEQ ID NO. 107
NGO-Br-37
MK661/T3 5'

NM_006644.1, AF039695.1, AB003334.1, AB003333.1, D86956.1, NM_013559.1, D67017.1, D67016.1, L40406.1,
Z47807.1, AB005282.1, AB005281.1, AL163279.2, AP193508.1, AE003720.1, AC009223.2, AC004251.1, AL163234.2,
AL161553.2, AL161539.2, AL139077.2, AP001689.1, Z97336.1, AP000477.2, AE003728.1, AE003686.1, AE003627.1,
AE003520.1, AF065404.1, AC000104.1, AC005 771.1, AF069291.1, U67495.1, AL163285.2, Z68004.1, AW571648.1,
AW572452.1, AW474070.1, AW470142.1, AA232636.1, AI658961.1, AW771160.1, AW316651.1, AW608075.1,
AW385582.1, AI651186.1, AA136424.1, AI223825.1, AA435594.1, AI582484.1, AI337175.1, AI288972.1, AA166806.1,
Z20100.1, AI799265.1, AW085874.1, AA624532.1, AA571473.1, AA571359.1, AA572403.1, AA417317.1, AI751852.1,
AA394027.1, AW020035.1, AI838486.1, C81194.1, T34627.1, Z21220.1, AW628153.1, AW103624.1, AW491178.1,
AI842560.1, AA843693.1, AV275994.1, AW604836.1, AA278231.1, AW820299.1, AA485036.1, AA953645.1,
AA967441.1, AA856248.1, AA079853.1, Z41841.1, AA238818.1, AW390368.1, AI115351.1, AV347805.1, AW147250.1,
AV348434.1, AV200611.1, AV181186.1, AV178670.1, AU055867.1, AI365340.1, AI341168.1, AA882330.1,
AA834218.1, C56104.1, C55163.1, C54236.1, C54007.1, C34122.1, C31088.1, C12303.1, D64277.1, T26732.1, D33807.1,
AW383218.1, AV272251.1, AV269906.1, AW037622.1, AI807000.1, AI804139.1, AA893644.1, AL137142.8,
AC012569.3, AP001895.1, AP001563.1, AC027117.2, AC022671.2, AC027128.3, AC023471.2, AC018818.3,
AF129408.1, AC021531.3, AC005506.6, AC021722.4, AC008361.7, AC018789.2, AC014468.1, AC044830.2,
AC008902.3, AC027359.2, AC009634.3, AC022530.4, AC026650.3, AC025973.2, AC019267.3, AC009925.3,
AC018717.5, AC015974.4, AC013110.1, Z98863.1,
SEQ ID NO. 108
NGO-Br-38
MK015/T3 5'

D86956.1, AB003334.1, NM_006644.1, AB003333.1, AF039695.1, D67017.1, D67016.1, NM013559.1, L40406.1,
Z47807.1, AB005267.1, AB005269.1, AB005268.1, AB023420.1, L12723.1, X67643.1, AC01101317 NM_008300.1,
AF077354.1, D85904.1, NM_0142781 NM_011020.1, U23921.1, AB023421.1, D49482.1, AI034403.18, NC_001145.1,
NM_004455.1, AC007240.2, U67191.1, AL121580.8, AL035448.28, Z49260.1, X67640.1, AC020629.6, AC007018.6,
AC004681.2, AE003808.1, AE003644.1, AE003458.1, AE003410.1, AC004740.1, NM_012980.1, AC004016.1,
AC007967.3, AC007447.6, AF132160.1, AC007073.2, AE001517.1, AC005938.1, U46034.1, AC004320.1, AF038606.1,
AL034423.18, AL109733.1, AL049548.6, Z98046.1, AW137489.1, AL120219.1, AW665093.1, AI052062.1, AI023309.1,
AU077146.1, AL043449.1, AA219339.1, AI0525 77.1, AA078767.1, AI003212.1, AAO81692.1, AW475 538.1, AI787816.1,
AI746652.1, AA360776.1, AI006526.1, AW209689.1, AW105834.1, AL045611.2, AI931227.1, AW227137.1,
AL044212.1, AU066691.1, AA168224.1, AW069322.1, AW318627.1, AI956249.1, AI316935.1,
AA408320.1, AW227160.1, AA407914.1, AA226851.1, AW557363.1, AW416815.1, AW141567.1, AI677492.1,
AI087282.1, AA840049.1, AA726333.1, AW223053.1, AV294240.1, AI986092.1, AI904139.1, AV052268.1, AI510184.1,
AI108231.1, AA799078.1, AA038974.1, N94129.1, AL137142.8, AL138965.3, AC046137.3, AC020834.2, AC015501.3,
AC021286.3, AC019130.3, AL161914.6, AC026223.2, AC023996.2, AL355495.1, AC068988.2, AC053523.2,
AC016937.3, AC0I6496.3, AC019266.3, AC026641.1, AC024429.2, AC019108.4, AC009969.4, AC023395.2,
AC060786.2, AC023513.8, AC023599.7, AC068719.1, AC023175.1, AC024943.5, AC027239.2, AC023257.2,
AC027676.2, AC027070.2, AC011230.2, AC044785.1, AC024673.2, AC009560.3, AC015810.3, AC019276.3,
AC021701.3, AC025813.1, AC024370.2, AC008350.3, AC021304.2, AC009972.4, AC012344.3, AC018305.1,
AC008232.3, AC014298.1, AC015847.1, AC013236.1, AL109835.12, AL139110.1, AP001998.1, AP001782.1,
SEQ ID NO. 109
NGO-Br-38
MK015/T7 3'

AF039695.1, D86956.1, NM_006644.1, AB003334.1, AB003333.1, D67017.1, D67016.1, AB005282.1, NM_013559.1,
L40406.1, Z47807.1, AE003611.1, AL035259.1, AC007677.3, AE003628.1, AE003571.1, AE003567.1, AC007066.4,
AL022164.1, AF218257.1, AC016752.2, AC006413.3, AE003477.1, AC005927.2, AC007061.5, U71249.1, AC003078.1,
U95740.1, AP104919.1, AC005324.1, AL133419.15, AL034955.3, AL138995.3, AL161492.2, AL035706.10, AL049188.3,
AJ010316.1, AB004275.1, AB006696.1, AP000555.1, Z11695.1, AB006689.1, AA843693.1, AA543054.1, AI742981.1,
AW612980.1, AW612983.1, AI582881.1, AI751853.1, AI378269.1, AI920808.1, AI654608.1, AI819251.1, AI337175.1,
AI753470.1, AI831339.1, AI312753.1, M803588.1, AI563996.1, AW015796.1, AW117974.1, AI668853.1, AA993280.1,
AA912023.1, AA535277.1, AII23280.1, AA632202.1, AW027050.1, AW627645.1, AA761750.1, AI223412.1,
AA219263.1, AW068948.1, AA166716.1, AA482770.1, AW236067.1, AA485151.1, AI369932.1, AI250881.1,
AA933881.1, AI262020.1, AI050716.1, H52653.1, AA678506.1, AA582157.1, AW340810.1, AI493255.1, AW837156.1,
AI673134.1, T58153.1, T36072.1, P22410.1, AA417317.1, AW020035.1, AI361237.1, AA278231.1, AA810686.1,
AA730742.1, AA082043.1, D58216.1, D29622.1, AA233888.1, AI630481.1, AI612928.1, D29371.1, AA731716.1,
AA417255.1, AA804371.1, AA465183.1, AA780104.1, AA491870.1, T34783.1, Z41841.1, AW771160.1, AI357434.1,
AI799265.1, AI582484.1, AI288972.1, F03714.1, AW381433.1, AW381418.1, T10428.1, AW163535.1, AW059721.1,
AA773435.1, AI651186.1, AW824279.1, AW544862.1, AW061135.1, AL117974.1, AW049097.1, AW011890.1,
AI845946.1, AU019569.1, AU019107.1, C78223.1, C78213.1, C77722.1, AA048547.1, AA986561.1, AI154454.1,
AW700938.1, AL137142.8, AC011966.3, AC027326.2, AC027323.2, AC010622.3, AC020999.4, AC018938.3,
AC018104.1, AC004390.1, AL161779.7, AP001547.1, AP000635.1, AP000610.2, AC022101.3, AC010093.3,
AC011799.5, AC023003.2, AC018466.3, AC020183.1, AC014557.1, AC015076.1, AC009849.6, AC0R 1758.5,
AC025391.3, AC022516.3, AC044816.2, AC026911.2, AC022462.3, AC015684.3, AC009835.5, AC015714.4,
AC011227.3, AC010018.4, AL355575.2, AL133344.21, AL157687.2, AL034359.4

TABLE 1-continued

Sequence homologies (GenBank Accession Numbers)

SEQ ID NO. 110
NGO-Br-38
MK249/T7 3'

AF039695.1, U86956.1, NM_006644.1, AB003334.1, AB003333.1, Z47807.1, D67017.1, D67016.1, AB005282.1,
NM_013559.1, L40406.1, AC011661.5, AE003611.1, AL035259.1, A0004684.2, AE003571.1, AE003567.1, AC010168.6,
AF140273.1, U32370.1, U30930.1, AC002367.1, AE000823.1, AC002292.1, AL158059.2, AI006409.1, AB026658.1,
AF218257.1, AC016752.2, AC009155.3, AC006413.3, U09675.1, AC005927.2, AC007061.5, AF030694.2, AF222716.1,
U95740.1, AC009501.3, AC005083.1, AC007590.1, AF104919.1, AF074946.1, AF030693.1, AF030692.1, AC005324.1,
AL133419.15, AL034556.3, AL034560.3, AL110502.1, AL049779.4, AL049188.3, U27707.1, U40933.1, U41018.1,
AB004275.1, AP000069.1, AB006696.1, Z18921.1, AB006689.1, AA543054.1, AA843693.1, AW612980.1, AI582881.1,
AW612983.1, AI378269.1, AI920808.1, AI654608.1, AI742981.1, AI312753.1, AI753470.1, AI831339.1, AI819251.1,
AI803588.1, AI751853.1, AI563996.1, AW117974.1, AI668853.1, AA993280.1, AA632202.1, AA219263.1, AW627645.1,
AW015796.1, AI337175.1, AI123280.1, AA912023.1, AA761750.1, AW027050.1, AI223412.1, AA535277.1,
AA485151.1, AA166716.1, AW236067.1, AI369932.1, AI250881.1, AA482770.1, AA933881.1, AI262020.1, AI050716.1,
AI493255.1, AA678506.1, AA582157.1, AW340810.1, AI673134.1, H52653.1, T58153.1, AW068948.1, AJ361237.1,
AA810686.1, T36072.1, F22410.1, AW837156.1, AA417317.1, AA082043.1, DS8216.1, D29622.1, AA278231.1,
AW020035.1, AI612928.1, AI630481.1, AA730742.1, U29371.1, AA731716.1, AA417255.1, AA804371.1, AA465183.1,
AA233888.1, AA780104.1, AA491870.1, AI357434.1, AW381433.1, AW163535.1, T34783.1, T10428.1, AW381418.1,
Z41841.1, AW771160.1, F03714.1, AI799265.1, AI582484.1, AI288972.1, AW059721.1, AA773435.1, AW470142.1,
AI651186.1, AI223825.1, AA232636.1, T34627.1, Z20100.1, Z21220.1, AI658961.1, AA136424.1, AW824279.1,
AL117974.1, AW049097.1, AI845946.1, C78213.1, AA048547.1, AA986561.1, AW700938.1, AL137142.8, AC011966.3,
AC018938.3, AC019338.4, AC018104.1, AP001547.1, AP000635.1, AP000610.2, AC022101.3, AC067877.1,
AC018700.3, AC010093.3, AC008107.2, AC022636.3, AC011799.5, AC009919.2, AC014557.1, AC015336.1,
AC015076.1, AL354655.3, AL353639.2, AL161449.2, AC025440.3, AC022516.3, AC008395.5, AC027149.2,
AC019075.6, AC067945.1, AC026911.2, AC023461.2, AC025246.5, AC055117.1, AC027646.3, AC015714.4,
AC026641.1, AC006281.6, AC018934.2, AC009015.2, AC002043.1, AC023302.2, AC006763.1, AC006187.1,
AL139318.2, AL132640.1, AL138776.2, AL136303.3, AL049183.5, AL034359.4, AP000540.1,
SEQ ID NO. 111
NGO-Br-38
MK4110/T3 5'

NM_006644.1, AB003334.1, AB003333.1, D86956.1, AF039695.1, D67017.1, U67016.1, Z47807.1, NM_013559.1,
L40406.1, AB005267.1, AB023420.1, L12723.1, X67643.1 NM_008300.1, AC011013.17, D85904.1, AF077354.1,
NM_014278.1, NM_011020.1, U23921.1, AB023421.1, D49482.1, AB005268.1, NM_004455.1, U67191.1, AC006661.2,
AE003724.1, U95739.1, AW137489.1, AW665093.1, AL120219.1, AI052062.1, AI023309.1, AU077146.1, AI052577.1,
AA219339.1, AI003212.1, AA078767.1, AL043449.1, AW475538.1, AW227137.1, AW105834.1, AI931227.1,
AI787816.1, AI746652.1, AI006526.1, AW209689.1, AU066691.1, AA168224.1, AAO81692.1, AW069322.1,
AW318627.1, AI956324.1, AI956249.1, AI316935.1, AA408320.1, AW072158.1, AA407914.1, AL044212.1,
AA226851.1, AW141567.1, AA840049.1, AA726333.1, AW416815.1, AI087282.1, AI510184.1, AA799078.1,
AA038974.1, AW281373.1, AW249190.1, AW174950.1, AW140856.1, AI777243.1, AI717978.1, M667993.1,
AI593889.1, AI564662.1, AI548407.1, AI132100.1, AA798531.1, AA657153.1, AA309538.1, AA010464.1, W52045.1,
W39574.1, N77720.1, AL137142.8, AL138965.3, AC046137.3, AC020834.2, AC015501.3, AC021286.3, AC068888.1,
AC008686.5, AC023175.1, AC027676.2, AC044785.1, AC015810.3, AC009972.4, AC006091.9, AC017374.1,
AC006802.1, AL354832.2, AL354813.2,
SEQ ID NO. 112
NGO-Br-38
MK447/T3 5'

AC004079.1, AL023812.1, AF116671.1, AC010739.3, NM_000146.1, AF147331.1, AL031670.6, Z94054.1, I27679.1,
M12938.1, M11147.1, X03743.1, M10119.1, AW516833.1, AW300978.1, AW162231.1, AV257466.1, AW157374.1,
AW079316.1, AW009956.1, AW004961.1, AI962098.1, AI815894.1, AI755008.1, AI748966.1, AI718110.1, AI709101.1,
AI672960.1, F19164.2, AI589785.1, AI583347.1, AI479061.1, M420287.1, AI361309.1, AI354529.1, AI292111.1,
AI219615.1, AI219349.1, AI214612.1, AI200269.1, AI193445.1, AI189444.1, AI184382.1, AI143808.1, AI127965.1,
AI127854.1, AI093293.1, AI089317.1, AI015377.1, AA989142.1, AA970214.1, AA946915.1, AA928899.1, AA918624.1,
AA876284.1, AA861967.1, AA857441.1, AA854288.1, AA845736.1, AA838065.1, AA838024.1, AA775012.1,
AA757403.1, AA658536.1, AA654568.1, AA618051.1, AA604054.1, AA600804.1, AA588452.1, AA587371.1,
AA587071.1, AA582703.1, AA582484.1, AA582386.1, AA568291.1, AA564050.1, AA555249.1, AA541585.1,
AA533130.1, AA531161.1, AA515081.1, AA494515.1, AA486095.1, AA468679.1, AA399366.1, AA373996.1,
AA342114.1, AA223994.1, AA206785.1, AA192374.1, AA187220.1, AA152396.1, AA085100.1, AA083345.1,
AA057726.1, AA039420.1, AA028129.1, AA011234.1, W40483.1, W40152.1, N79615.1, N53835.1, N42345.1, N25279.1,
H66026.1, R97999.1, D51234.1, H22588.1, R28740.1, T60144.1, T19029.1, AC023169.3, AC021399.3, AC022015.2,
AC016474.2, AC018910.4, AC024270.1, AC016185.1, AC021886.4, AC068615.2, AC068712.1, AC040169.2,
AC026803.2, AC008749.4, AC022916.2, AC021554.4, AC027626.2, AC024616.1, AC009867.1, AL139824.12,
AC003117.1, AL139158.1, AP001939.1, AP001374.1
SEQ ID NO. 113
NGO-Br-38
MK447/T7 3'

AF039695.1, D86956.1, NM_006644.1, AB003334.1, AB003333.1, D67017.1, U67016.1, AB005282.1, NM_013559.1,
L40406.1, Z47807.1, AF262041.1, AC000065.1, AC011661.5, AL034560.3, AL035259.1, AC004684.2, AE003567.1,
AC007049.8, AC005992.1, AC016752.2, AC006586.9, AC004165.2, AL133419.15, AL034556.3, AL117202.1,
Z68116.1, AL049188.3, U27707.1, AJ010316.1, AP000555.1, AA843693.1, AA543054.1, AI742981.1, AW612980.1,
AW612983.1, AI582881.1, AI378269.1, AI920808.1, AI751853.1, AI654608.1, AI819251.1, AI831339.1, AI753470.1,
AI312753.1, AI803588.1, AI563996.1, AW015796.1, AW117974.1, AI668853.1, AA535277.1, AA993280.1, AA632202.1,
AA912023.1, AW627645.1, AW027050.1, AI337175.1, AI123280.1, AA761750.1, AI223412.1, AA219263.1,
AW068948.1, AA482770.1, AA166716.1, AW236067.1, AA485151.1, AI369932.1, AI250881.1, AA933881.1,

TABLE 1-continued

Sequence homologies (GenBank Accession Numbers)

AI262020.1, AI050716.1, H52653.1, AA678506.1, AA582157.1, AI493255.1, AW340810.1, AW837156.1, AI673134.1,
T58153.1, T36072.1, F22410.1, AA417317.1, AW020035.1, AI361237.1, AA278231.1, AA810686.1, AA730742.1,
AA082043.1, D58216.1, D29622.1, AA233888.1, AI612928.1, D29371.1, AI630481.1, AA731716.1, AA417255.1,
AA804371.1, AA465183.1, AA780104.1, AA491870.1, T34783.1, Z41841.1, AW771160.1, AI357434.1, AI799265.1,
AI582484.1, AI288972.1, F03714.1, AW381433.1, AW381418.1, T10428.1, AW163535.1, Z21220.1, AW4701421
AI651186.1, AI223825.1, AA232636.1, Z20100.1, T34627.1, AI658961.1, AA136424.1, AW059721.1, AW571648.1,
AA773435.1, AW544862.1, AI790491.1, AU019107.1, C78223.1, AI115351.1, AW700938.1, AA238818.1, AL137142.8,
AC010034.5, AC011966.3, AC027326.2, AC018938.3, AC018104.1, AC004390.1, AP000635.1, AP000610.2,
AC068643.5, AC022101.3, AC020183.1, AC009849.6, AC018934.2, AL354895.3, AL353639.2, AL133344.21,
AL157687.2, Z98865.1, Z92818.1,
SEQ ID NO. 114
NGO-Br-38
MK633/T3 5'

NM_006644.1, AF039695.1, AB003334.1, AB003333.1, D86956.1, U67017.1, D67016.1, Z47807.1, NM_013559.1,
L40406.1, AB005282.1, AB005281.1, AB005280.1, AB023420.1, X67643.1, NM_008300.1, D85904.1, AE003525.1,
AL163279.2, AL109620.4, AF193508.1, AE003720.1, AE003589.1, AE003522.1, AC009223.2, AC004251.1,
AC002367.1, AL163234.2, AL161553.2, AL161539.2, AL139077.2, AL009183.10, AP001689.1, Z97336.1, AP000477.2,
AI658961.1, AW571648.1, AW474070.1, AW608075.1, AW572452.1, AW385582.1, AW470142.1, AA232636.1,
AW316651.1, AA166806.1, AI751852.1, AW771160.1, AW628153.1, AI651186.1, AA953645.1, AW820299.1,
AA394027.1, AI223825.1, AA136424.1, AW390368.1, AI582484.1, AW103624.1, AW604836.1, AI337175.1,
AI288972.1, AA435594.1, AA485036.1, F07487.1, AA571359.1, Z20100.1, F08794.1, AW799265.1, T63090.1,
AW859988.1, AW859943.1, AA624532.1, AW820234.1, AI838486.1, AW609781.1, C81194.1, AW085874.1,
AW820232.1, AA572403.1, AW020035.1, AA571473.1, T34627.1, Z21220.1, AA417317.1, AA278231.1, AA843693.1,
AW389335.1, Z41841.1, AA079853.1, AW491178.1, AI842560.1, AV275994.1, AA777031.1, AA967441.1, AA856248.1,
AW837156.1, AA238818.1, H52653.1, T34783.1, AI751853.1, F03714.1, AW861588.1, AW819997.1, AW819755.1,
AW604699.1, AW366794.1, AW085727.1, AW068948.1, AI925201.1, AI754819.1, AI567970.1, AA703912.1,
AA493400.1, AA173193.1, R54223.1, AI115351.1, AW545353.1, AW545094.1, AW542227.1, AW537735.1,
AW060626.1, AI956869.1, AV146133.1, AI528497.1, AA823019.1, AA799083.1, AA462732.1, AA445826.1,
AW754207.1, AA205597.1, AW604696.1, AV279553.1, AV149067.1, AI600071.1, AL137142.8, AC012569.3,
AP001895.1, AP001563.1, AC023471.2, AC018495.3, AC010070.5, AC010069.6, AC015471.1, AP129408.1,
AC022797.3, AC021531.3, AC005506.6, AC021722.4, AC009039.5, AC007337.2, AC008361.7, AC014468.1,
AL162502.2, AC034128.2, AC018700.3, AC022530.4, AC019267.3, AC009925.3, AC024681.2, AC022461.3,
AL109916.3, AL138705.3, AL161449.2, Z98863.1,
SEQ ID NO. 115
NGO-Br-40 combined NM_004120.2, M55543.1, AK001823.1, NM_002053.1, M55542.1, NM_010259.1, M63961.1, M55544.1, M80367.1,
MM_010260.1, AF109168.1, AF077007.1, AI007970.1, U44731.1, NM_008620.1, M81128.1, AC022522.2, AC006487.7,
AL135749.2, X77129.1, Z95388.1, AC004930.1, AC005028.1, Z7854.6,1, NC_001143.1, AE003472.1, NM_000379.1,
AF085699.1, AF178650.1, AC007980.1, AC005557.1, AC005669.1, AL109935.39, AL163226.2, AL133283.9,
AL008639.15, AL121654.1, X92112.1, AP001681.1, AL117265.1, AB038490.1, U39487.1, AL035640.2, Z28127.1,
X72016.1, U06117.1, Y10720.1, AP001137.1, AB015429.1, AB020867.1, U10044.1, D11456.1, AW001215.1,
AI830004.1, AW058212.1, AA876142.1, AI983562.1, AI439472.1, AW820994.1, AW468007.1, AI969542.1, AI760378.1,
AW078537.1, AW614912.1, AW577433.1, AA075477.1, W37973.1, AI870195.1, AW804484.1, AI906045.1, AI859339.1,
AA622193.1, AW341927.1, W37755.1, AI500511.1, AA642656.1, AI492530.1, AI902944.1, AI500507.1, AA837842.1,
AI865686.1, AA075671.1, AA131850.1, AA635989.1, AA587444.1, AW297239.1, AI285460.1, AW804456.1,
AW821048.1, AI862178.1, AW793466.1, AI922648.1, AA937007.1, AA903286.1, AW373870.1, AI289455.1,
AI251115.1, AA533156.1, AI084027.1, AW368079.1, AA627607.1, AW362711.1, AA532369.1, AA579973.1,
AW815880.1, AA586545.1, AA917383.1, AW026936.1, AI138455.1, W72748.1, T29528.1, AI962517.1, AI795779.1,
AI073859.1, AW797814.1, AW578905.1, AI371522.1, AA044192.1, AW861558.1, AW609821.1, AW797815.1,
AI702366.1, AA471169.1, AI683358.1, AI528561.1, AW320458.1, AA424070.1, AA164464.1, AI989871.1, AW474440.1,
AI683206.1, AA122936.1, W01896.1, AA880099.1, AA100063.1, AW211765.1, AI905784.1, AI905719.1, AA305909.1,
AI811907.1, AW797793.1, AW629741.1, AA354725.1, H05350.1, AW817431.1, AA486849.1, F06345.1, AW239153.1,
AA174655.1, AA347633.1, AA315174.1, AA487747.1, AL161639.4, AL160008.1, AL139416.1, AU38786.3,
AC021689.2, AL355818.2, AC060233.1, AC021626.3, AC009729.4, AC026091.3, AC010872.4, AU38889.2,
AP000831.1, AC013475.4, AC024551.3, AC024150.5, AC060776.2, AC063963.3, AC008373.6, AC010630.3,
AC034166.2, AC021399.3, AC025799.2, AC016190.3, AC025482.2, AC027133.1, AC022015.2, AC024303.2,
AC018807.4, AC016720.4, AC016696.4, AC011210.3, AC016474.2, AC019071.2, AC010118.5, AC010743.4,
AC017393.1, U82205.1, AL158849.7, AL356126.1, AL158070.2, AP001809.1,
SEQ ID NO. 116
NGO-Br-40
MK121/T3 5=
NM_004120.2, M55543.1, NM_002053.1, M55542.1, AK001823.1, NM_010259.1, M63961.1, M55544.1, M80367.1,
NM_010260.1, AF109168.1, AF077007.1, AJ007970.1, U44731.1, NM_008620.1, M81128.1, X77129.1, Z95388.1,
Z78546.1, AE003629.1, AE003472.1, AF085699.1, AC007980.1, AC005557.1, AL133283.9, AL008639.15, X92112.1,
AL117265.1, AB015429.1, AF257304.1, AF257303.1, AE003459.1, AC007177.1, U69633.1, AL117319.1, AL031587.3,
AW297239.1, AI962517.1, AI795779.1, AW320458.1, AI528561.1, AW368079.1, AA424070.1, AA122936.1,
AA880099.1, AA100063.1, AW211765.1, AA305909.1, AW36271.1,1, AW629741.1, AA354725.1, AW815880.1,
AW239153.1, AA347633.1, AA296543.1, AA709608.1, AA337079.1, AA911189.1, AA873192.1, F14838.1, AU076892.1,
AA576498.1, AW106727.1, AA878690.1, W77927.1, AW428394.1, AA296485.1, AI906045.1, AA131850.1,
AW820809.1, T83604.1, F 14828.1, AA487747.1, AW669464.1, AW817439.1, AW609764.1, AA158924.1, AU076806.1,
T75545.1, AW817360.1, AI980812.1, AI626652.1, AA848004.1, W13273.1, AI979397.1, AI529783.1, AI194988.1,
AA889865.1, C05965.1, R54285.1, R54280.1, F06574.1, T34309.1, T32678.1, AW399587.1, AW398501.1, AA955194.1,
C77542.1, AL161639.4, AL160008.1, AL139416.1, AC021689.2, AL138786.3, AL355818.2, AC021626.3, AC010872.4,
AC024551.3, AC060776.2, AC063963.3, A0021399.3, AC025482.2, AC022015.2, AC007147.7, AC011210.3,
AC016474.2, AC010118.5, AC020189.1, AC017393.1, U82205.1, AL356126.1, AC026877.4, AC064824.2, AC053519.2,

TABLE 1-continued

Sequence homologies (GenBank Accession Numbers)

AC027322.2, AC008494.7, AC016942.4, AC010289.3, AC019282.2, AC027620.3, AC023888.6, AC037442.1, AC026047.2, AC013693.3, AC021769.3, AC020577.1, AC019338.4, AC013718.3, AC015469.2, AC023823.2, AC013415.3, AC020230.1, AC021758.1, AC016495.1, AC013276.2, AC013485.1, AC0I2667.1, AC007515.1, AL355532.4, AL356008.1, AL354918.3, AL079302.3, AP002010.1, AP001807.1, AP001642.1, AP001638.1, AP001461.2, AP001324.1, AP001104.1,
SEQ ID NO. 117
NGO-Br-40
MK121/T7 3'

NM_004120.2, M55543.1, AK001823.1, NM_002053.1, M55542.1, NM_010259.1, M63961.1, M55544.1, M80367.1, NM010260.1, AF109168.1, AF077007.1, AJ007970.1, AC022522.2, AC006487.7, AC005028.1, AL163226.2, AL121963.10, AP001681.1, AL035640.2, Y10720.1, AP001137.1, AC007236.4, AC018769.2, NM_007199.1, AF178650.1, AP113136.1, AC006241.1, U78259.1, AL163235.2, AL135749.2, AL109984.14, AP001690.1, AP000476.2, AB005234.1, AW614912.1, AI830004.1, AW001215.1, AA876142.1, AW058212.1, AI760378.1, AI439472.1, AW078537.1, AI983562.1, AA075477.1, AI870195.1, AA622193.1, AW341927.1, W37755.1, W37973.1, AA642656.1, AI492530.1, AI500507.1, AA837842.1, AI865686.1, AA587444.1, AA635989.1, AI285460.1, AI862178.1, AA937007.1, AA903286.1, AI289455.1, AA533156.1, AI084027.1, AA627607.1, AW373870.1, AA075671.1, AA532369.1, AA579973.1, AA917383.1, AW026936.1, AW793466.1, AI138455.1, T29528.1, AW577433.1, AI073859.1, AI371522.1, AI702366.1, AW609821.1, W01896.1, AI500511.1, AW468007.1, AI969542.1, AI859339.1, AI922648.1, AA586545.1, AA487528.1, AA315174.1, AI081732.1, AI075062.1, AA937600.1, AW449506.1, AA827350.1, AA131800.1, AA810201.1, AA650178.1, AI280597.1, AA424529.1, AW799191.1, AI910674.1, AA486850.1, AA837672.1, AA834863.1, AI905784.1, AI905719.1, AI861968.1, AI251115.1, AW817431.1, AW304126.1, AA564905.1, AA056488.1, AW363341.1, AW805514.1, AW796865.1, AW804484.1, AA424397.1, AI372935.1, AA587703.1, H05300.1, AI246407.1, AW820994.1, AW799183.1, W37972.1, AW821048.1, AW470713.1, AW363352.1, AW797212.1, AI760921.1, M007134.1, AA175795.1, AA139382.1, AI386222.1, AI036133.1, AA153027.1, AA153021.1, AL161639.4, AL139416.1, AL160008.1, AC060233.1, AC026091.3, AC013475.4, AC025799.2, AC012246.3, AC016190.3, AC027133.1, AC022895.2, AL121573.10, AL355373.1, AC012264.8, AC022330.9, AC018461.18, AC026777.2, AC026737.3, AC026704.3, AC022418.3, AC010230.3, AC009051.5, AC009050.4, AC025073.2, AC027110.2, AC027630.4, AC027453.2, AC010159.7, AC027168.2, AC026590.2, AC0I5972.3, AC021149.4, AC025790.2, AC021688.2, AC018807.4, AC016686.4, AC011864.3, AC024403.2, AC024278.1, AC021339.3, AC013725.2, AC018408.1, AC013404.1, AC012545.1, AL162497.6, AL139275.6, AL139274.6, AL136380.2, AL355820.2, AL157818.2,
SEQ ID NO. 118
NGO-Br-40
MK221/T3 5'

NM_004120.2, M55543.1, NM_002053.1, M55542.1, M80367.1, NM_010259.1, M63961.1, M55544.1, AK001823.1, NM_010260.1, AF109168.1, AF077007.1, AJ007970.1, U44731.1, NM_008620.1, M81128.1, X77129.1, Z95388.1, AC004930.1, NC_001143.1, AF085699.1, AC007980.1, AC005669.1, AL109935.39, AB038490.1, Z28127.1, X72016.1, AB015429.1, AB020867.1, NM_0015672 AC005917.2, AE003603.1 NM_013134.1, NM_006460.1, AC006312.8, AC004798.1, AC003111.1, AL161516.2, AL133304.2, AL049487.1, L36818.1, Y14385.1, AB021179.1, M29249.1, X93922.1, AI906045.1, AA131850.1, AW368079.1, AW362711.1, AW815880.1, W72748.1, AW297239.1, AW820994.1, AI902944.1, AW578905.1, AW861558.1, AA044192.1, H05350.1, AA486849.1, F06345.1, AW804456.1, W77927.1, AW821048.1, AW804484.1, AI969542.1, AI962517.1, AI683358.1, AA911189.1, AA164464.1, AW468007.1, AI989871.1, AI528561.1, AW474440.1, AI683206.1, AA878690.1, AA487367.1, P07031.1, AW804431.1, AA487747.1, AI905784.1, M905719.1, AA873192.1, AI922648.1, AW320458.1, AW211765.1, AA122936.1, AW820809.1, AW106727.1, AA174655.1, T83604.1, I75545.1, AW817439.1, AW609764.1, AI811907.1, AW817360.1, AA610352.1, F05698.1, AI859339.1, AW797814.1, AA471169.1, AA880099.1, AW577433.1, AI500511.1, AA044017.1, T87056.1, AI922921.1, AA848004.1, AA506001.1, AV362793.1, AA582749.1, W13273.1, AI651570.1, AI075062.1, AA690573.1, AA665504.1, AA057242.1, AW665096.1, AW454822.1, AL135036.1, AW166154.1, AI811680.1, AI796944.1, AV046437.2, AA955194.1, AI383864.1, AI216433.1, AA928789.1, AA927260.1, AA909971.1, AA890309.1, T43327.1, AA719024.1, C77542.1, AA099506.1, N33318.1, N21081.1, R65420.1, H36685.1, H16325.1, T41892.1, Z44502.1, AL161639.4, AL160008.1, AL139416.1, AL138786.3, AL355818.2, AC021689.2, AL137851.3, AP000831.1, AC024150.5, AC034166.2, AC024303.2, AC016696.4, AC011860.3, AL158849.7, AL158070.2, AC036129.2, AC021630.4, AC018354.6, AC012053.2, AC025975.2, AC027743.1, AC024047.2, AC026047.2, AC025865.2, AC013612.3, AC022854.3, AC022679.3, AC020753.2, AC018814.3, AC018497.4, AC023201.2, AC006295.8, AC013759.2, AC017228.1, AF166490.1, AL354770.2, AL356008.1, AL355990.1, AL161658.3, AL160006.2, AP001385.1, AP001157.1, AP000812.1, AP000593.1, AP000485.2,
SEQ ID NO. 119
NGO-Br-40
MK221/T7 3'

NM_004120.2, M55543.1, AK001823.1, NM_002053.1, M55542.1, NM_010259.1, M63961.1, M55544.1, M80367.1, AC022522.2, NM_010260.1, AF109168.1, AF077007.1, AJ007970.1, AC006642.1, U28927.1, AL163226.2, AL049555.6, AP001681.1, U40937.1, AP001137.1, AE002269.1, AC006241.1, AC004558.1, AF052729.1, AL163235.2, AP001690.1, Y10720.1, AP000476.2, AB005234.1, AB026654.1, M97632.1, AA876142.1, AW001215.1, AI830004.1, AW614912.1, AW058212.1, AI760378.1, AI439472.1, AW078537.1, AI983562.1, AA075477.1, AI870195.1, AW341927.1, AI492530.1, W37755.1, AA622193.1, W37973.1, AA642656.1, AI500507.1, AA837842.1, AI865686.1, AA635989.1, AI862178.1, AA587444.1, AI285460.1, AA937007.1, AA903286.1, AI289455.1, AA533156.1, AA627607.1, AI084027.1, AA532369.1, AA579973.1, AW373870.1, AA917383.1, AA075671.1, AW026936.1, AI138455.1, AI073859.1, AW793466.1, T29528.1, AI702366.1, AW577433.1, AI371522.1, W01896.1, AW609821.1, AI500511.1, AW468007.1, AI969542.1, AI859339.1, AI922648.1, AA586545.1, AI280597.1, AA131800.1, AA487528.1, AA315174.1, AW796865.1, AI081732.1, AI075062.1, AW449506.1, AA937600.1, AI905784.1, AI905719.1, AI251115.1, AA827350.1, AW817431.1, AW799191.1, AI910674.1, AA810201.1, AA650178.1, AA486850.1, AW804484.1, AA424529.1, AA837672.1, AA834863.1, AI861968.1, AW304126.1, AA564905.1, AA056488.1, AW805514.1, AW363341.1, AA424397.1, AW820994.1, AI372935.1, AI246407.1, AI400402.1, AA587703.1, AW799183.1, AW804508.1, W37972.1, AW821048.1, AW799555.1, AW797212.1, AI760921.1, AA947554.1, H05300.1, AI007134.1, AA175795.1, AA139382.1, AL161639.4, AL139416.1, AL160008.1, AC026091.3, AC013475.4, AC027453.2, AC016190.3, AC021149.4, AC027133.1, AC021688.2,

TABLE 1-continued

Sequence homologies (GenBank Accession Numbers)

AC016774.2, AC006883.2, AC022330.9, AC018461.18, AC022418.3, AC010230.3, AC00g0515, AC009050.4,
AC011784.3, AC027168.2, AC009625.3, AC026590.2, AC015972.3, AC016686.4, AC024403.2, AC013404.1,
AC012545.1, AL139275.6, AL139274.6, AL354758.3, AL157714.3, AL160058.3, AL157818.2, AL158072.2,
SEQ ID NO. 120
NGO-Br-40
MK241/T3 5'

NM_004120.2, M55543.1, NM_002053.1, M55542.1, AK001823.1, NM_010259.1, M63961.1, M55544.1, M80367.1,
NM_010260.1, AF109168.1, AF077007.1, AJ007970.1, U44731.1, NM_008620.1, M81128.1, AC006112.2, X77129.1,
Z95388.1, Z78546.1, AE003472.1, AC004969.1, AC005053.1, AC005061.2, AF085699.1, AC007980.1, AC005557.1,
AL109935.39, AL133283.9, AL008639.15, X92112.1, AL117265.1, AB015429.1, AB020867.1, AF257304.1, AF257303.1,
AE003459.1, NM_013134.1, AC007177.1, AC004798.1, AC003111.1, AF003626.1, U69633.1, AL117319.1, AL034426.4,
AL031587.3, U29614.1, M29249.1, AW297239.1, AW368079.1, AI962517.1, AW362711.1, AW815880.1, AI795779.1,
AI528561.1, AW320458.1, AA122936.1, AA880099.1, AA424070.1, AW211765.1, AA100063.1, AA305909.1,
AA354725.1, AI906045.1, AW629741.1, AA131850.1, AA347633.1, AW239153.1, AA709608.1, AA296543.1, W77927.1,
AA911189.1, AA878690.1, AA873192.1, AA337079.1, P14838.1, AW106727.1, AA576498.1, W72748.1, AW428394.1,
AI905784.1, AI905719.1, AW820809.1, AA487747.1, T83604.1, I75545.1, AW817439.1, AW609764.1, AA296485.1,
AW517360.1, F14828.1, AW578905.1, AW861558.1, AW669464.1, AA158924.1, AU076892.1, AI626652.1, AI979397.1,
AI922921.1, AI980812.1, AA848004.1, AA506001.1, AA582749.1, W13273.1, AI651570.1, AI529783.1, AI194988.1,
AA889865.1, C05965.1, R54285.1, R54280.1, F06574.1, T34309.1, T32678.1, AW399587.1, AW398501.1, AW256377.1,
AV046437.2, AA955194.1, C90826.1, C77542.1, AL161639.4, AL160008.1, AL139416.1, AC021689.2, AL138786.3,
AL355818.2, AC021626.3, AC007223.1, AC010872.4, AC024551.3, AC060776.2, AC063963.3, AC034166.2,
AC021399.3, AC025482.2, AC022015.2, AC024303.2, AC016696.4, AC011210.3, AC016474.2, AC010118.5,
AC020825.2, AC019249.3, AC017393.1, U82205.1, AL356126.1,
SEQ ID NO. 121
NGO-Br-40
MK241/T7 3'

NM_004120.2, M55543.1, AK001823.1, NM_002053.1, M55542.1, NM_010259.1, M63961.1, M55544.1, M80367.1,
NM_010260.1, AF109168.1, AF077007.1, AI007970.1, AC006487.7, AC005028.1, AF235093.1, AC022522.2, U97404.1,
AL163226.2, AL163210.2, AP001681.1, AJ010598.1, AL035640.2, AP001137.1, AE002269.1, NM_007199.1,
AF113136.1, AC006241.1, U41556.1, AL163235.2, AL109984.14, Z82288.2, Z81102.1, Z70285.1, AP001690.1,
U37429.1, Y10720.1, Z73419.1, AP000476.2, AB005234.1, AW614912.1, AI830004.1, AW001215.1, AA876142.1,
AW058212.1, AW078537.1, AI760378.1, AI439472.1, AA075477.1, AI870195.1, AI983562.1, AI492530.1, AW341927.1,
AA622193.1, W37755.1, AI500507.1, AA642656.1, AA837842.1, AI865686.1, W37973.1, AA635989.1, AI862178.1,
AA587444.1, AI285460.1, AA903286.1, AA937007.1, AI289455.1, AA533156.1, AI084027.1, AA532369.1, AA627607.1,
AA579973.1, AA917383.1, AW026936.1, AI138455.1, AW373870.1, AI073859.1, AA075671.1, AI371522.1, AI702366.1,
W01896.1, AW793466.1, T29528.1, AW577433.1, AW609821.1, AI922648.1, AA131800.1, AI280597.1, AI500511.1,
AA487528.1, AA315174.1, AW468007.1, AI969542.1, AI859339.1, AW449506.1, AI081732.1, AI075062.1, AA937600.1,
AA486850.1, AW799191.1, AI910674.1, AA837672.1, AA834863.1, AA827350.1, AA810201.1, AA650178.1,
AA424529.1, AW796865.1, AW304126.1, AI861968.1, AA564905.1, AA056488.1, AA586545.1, AW363341.1,
AI246407.1, AA587703.1, AI372935.1, AW805514.1, H05300.1, AA424397.1, AW799183.1, AW470713.1, AI905784.1,
AI905719.1, AW817431.1, AW797212.1, AI251115.1, AI400402.1, AI760921.1, AW804484.1, AW820994.1,
AA947554.1, AI007134.1, AA175795.1, AA139382.1, AW821048.1, AA153021.1, AI386222.1, AA153027.1, W379721,
AL161639.4, AL139416.1, AL160008.1, AC060233.1, AC026091.3, AC013475.4, AC025799.2, AC016190.3,
AC063948.3, AC012264.8, AC024102.5, AC018461.18, AC026737.3, AC026704.3, AC022418.3, AC027630.4,
AC027168.2, AC026590.2, AC026549.2, AF235106.1, AC015972.3, AC034223.1, AC012148.2, AC025790.2,
AC008248.2, AC009256.7, AC024403.2, AC020798.2, AC022290.2, AC013404.1, AC008031.3, AC012545.1,
AL139275.6, AL139274.6, AL136380.2, AL355820.2, AL162421.1,
SEQ ID NO. 122
NGO-Br-40
MK255/T7 3'

NM_004120.2, M55543.1, AK001823.1, NM_002053.1, M55542.1, NM_010259.1, M63961.1, M55544.1, M80367.1,
NM_010260.1, AF109168.1, AF077007.1, A3007970.1, AC022522.2, AC006487.7, AL135749.2, AC005028.1,
AL162873.1, AE003782.1, AL163226.2, AP001681.1, AL035640.2, AP001137.1, AB011093.1, AF227618.1, AE002269.1,
AC007347.3, NM_007199.1, AF113136.1, AC006241.1, AL163235.2, AC002094.1, AL133246.2, AL109984.14,
Z49910.1, AP001690.1, X56844.1, Y10720.1, AP000476.2, AB005234.1, AI830004.1, AW001215.1, AA876142.1,
AW058212.1, AI760378.1, AW614912.1, AI983562.1, M439472.1, AW078537.1, AA075477.1, AI870195.1, W37973.1,
AA622193.1, AI492530.1, AW341927.1, W37755.1, AA642656.1, AI500507.1, AA837842.1, AI865686.1, AA635989.1,
AA587444.1, AI862178.1, AI285460.1, AA903286.1, AA937007.1, AI289455.1, AA533156.1, AW373870.1, AI084027.1,
AA075671.1, AA532369.1, AA627607.1, AA579973.1, AA917383.1, AW026936.1, AW793466.1, M138455.1,
AW577433.1, M073859.1, T29528.1, AI371522.1, AI702366.1, AW609821.1, AI500511.1, AW468007.1, AI969542.1,
AI859339.1, W01896.1, AA586545.1, AI922648.1, AI905784.1, AI905719.1, AI251115.1, AW817431.1, AA131800.1,
AA487528.1, AA315174.1, AI280597.1, AI05I732.1, AI075062.1, AW804484.1, AW449506.1, AA937600.1,
AA827350.1, AW799191.1, AI910674.1, AA810201.1, AA650178.1, AA486850.1, AA837672.1, AA834863.1,
AA424529.1, AW304126.1, AI861968.1, AA564905.1, AA056488.1, AW820994.1, AW796865.1, AW804456.1,
AW797814.1, AI902944.1, AW797815.1, AW797793.1, AW363341.1, AI372935.1, AA587703.1, AW805514.1,
AI246407.1, AW821048.1, AA424397.1, H05300.1, AW799183.1, W37972.1, AW470713.1, AA175795.1, AA139382.1,
AA153021.1, AI386222.1, AA153027.1, AL161639.4, AL139416.1, AL160008.1, AC060233.1, AC026091.3,
AC013475.4, AC008878.6, AC008373.6, AC010630.3, AC025799.2, AC016190.3, AC027133.1, AC011764.5,
AC014685.1,

TABLE 1-continued

Sequence homologies (GenBank Accession Numbers)

SEQ ID NO. 123
NGO-Br-40
MK303/T3 5'

NM_004120.2, M55543.1, NM_002053.1, M55542.1, AK001823.1, NM_010259.1, M63961.1, M55544.1, NM_010260.1, AF109168.1, AF077007.1, AJ007970.1, M80367.1, AC004930.1, AL135749.2, AP000350.1, NC_001143.1, NM_000379.1, AC002288.1, AC005669.1, AF077537.1, AL121654.1, U39487.1, U39646.1, Z28127.1, X72016.1, U06117.1, 010044.1, D11456.1 NM_001567.2, AC009890.12, AC010489.4, AC007048.4, AC005917.2, AC006832.2, AE003603.1, AE003479.1, AC005781.1, AC002526.1, NM_006460.1, AF202730.1, AC003661.1, AC008125.9, U40939.1, AC007504.3, AC007785.1, L21934.2, AC004596.1, AC000028.1, AC005837.1, U81031.1, AC005215.1, AC003047.1, AC002094.1, AL161516.2, Z81088.1, AL049487.1, L36818.1, X15209.1, X15750.1, Y14385.1, AB021179.1, AW820994.1, AW804484.1, AW468007.1, AI969542.1, AI902944.1, AW804456.1, AI922648.1, AW821048.1, AI859339.1, AI500511.1, AW577433.1, AI251115.1, AW797814.1, AW797815.1, AA471169.1, AA044192.1, AI683358.1, AW578905.1, AA586545.1, AW001215.1, AW793466.1, AI989871.1, AI683206.1, AW474440.1, AI906045.1, AA164464.1, AA075671.1, AI830004.1, AI811907.1, AW797793.1, AW058212.1, AI983562.1, AA876142.1, H05350.1, AA131850.1, W72748.1, AI439472.1, AA486849.1, P06345.1, AW804431.1, AW373870.1, AA174655.1, AW817431.1, AI905784.1, AI905719.1, P23076.1, AA044017.1, AA610352.1, AA487747.1, AW609821.1, AI760378.1, AW078537.1, AA487367.1, AW614912.1, T87056.1, T29528.1, W37973.1, F07031.1, W37972.1, AA263171.1, AI492530.1, AA424397.1, AI865686.1, AA487528.1, AA294979.1, AW138402.1, AI386222.1, AI180927.1, AI036133.1, AA184762.1, AA153027.1, AA153021.1, AV362793.1, AA315174.1, F05698.1, AW815880.1, AW363341.1, AW362711.1, AA622193.1, AA057242.1, AI796944.1, T41892.1, AL161639.4, AL160005.1, AL139416.1, AL138786.3, AL355818.2, AC009158.3, AC024026.2, AL138782.5, AL138934.2, AL138889.2, AC024150.5, AC008373.6, AC010630.3, AC021689.2, AC048369.1, AC015803.3, AC019071.2, AC010743.4, AP001809.1,

SEQ ID NO. 124
NGO-Br-40
MK303/T7 3'

NM_004120.2, M55543.1, AK001823.1, NM_002053.1, M55542.1, NM_010259.1, M63961.1, M55544.1, M80367.1, NM_010260.1, AF109168.1, AF077007.1, AJ007970.1, AC022522.2, AC006487.7, AL135749.2, AC005028.1, AF178650.1, AL163226.2, AP001681.1, AL035640.2, Y10720.1, AP001137.1, AC011282.3, AE002269.1, AC006142.1, NM_011369.1, NM_0071991 AF113136.1, AF017152.1, AC006241.1, AF064699.1, AF069670.1, AF069669.1 AF057284.1, AL163235.2, AC002094.1, AL109984.14, AL139296.2, AL121871.8, AL161581.2, AL136132.15, U86532.1, AP001690.1, AL034567.1, X56844.1, AP000476.2, AB005234.1, L11794.1, L11777.1, X99948.1, AW001215.1, AW058212.1, AI830004.1, AA876142.1, AI760378.1, AW614912.1, AI983562.1, AI439472.1, AW078537.1, AA075477.1, AI870195.1, AA622193.1, W37973.1, AW341927.1, W37755.1, AA642656.1, AI492530.1, AI500507.1, AA837842.1, AI865686.1, AA635989.1, AA587444.1, AI285460.1, AI862178.1, AA937007.1, AA903286.1, AI289455.1, AA075671.1, AW373870.1, AA533156.1, M084027.1, AA627607.1, AA532369.1, AA579973.1, AW793466.1, AW577433.1, AA917383.1, AW026936.1, AI138455.1, T29528.1, AI500511.1, M859339.1, AI073859.1, AI969542.1, AW468007.1, AI371522.1, M702366.1, AW609821.1, W01896.1, AA586545.1, AI251115.1, AI922648.1, AW804484.1, AW820994.1, AI905784.1, AI905719.1, AW817431.1, AA131800.1, AA487528.1, AA315174.1, AI280597.1, AI081732.1, AI075062.1, AW449506.1, AA937600.1, AA827350.1, AW799191.1, AI910674.1, AA810201.1, AA650178.1, AA486850.1, AA424529.1, AA837672.1, AA834863.1, AI861968.1, AW796865.1, AW304126.1, AA564905.1, AA056488.1, AW804456.1, AI902944.1, AW363341.1, AW805514.1, AW821048.1, AI372935.1, AI246407.1, AA587703.1, AW797815.1, AW797814.1, AA424397.1, W37972.1, AW799183.1, H05300.1, AW470713.1, AI007134.1, AA175795.1, AA139382.1, AA153021.1, AI386222.1, AA153027.1, AL161639.4, AL139416.1, AL160008.1, AC060233.1, AC026091.3, AC013475.4, AC068832.1, AC008373.6, AC0I0630.3, AC025799.2, AC016190.3, AC027133.1, AC018807.4, AC016720.4, AC012444.3, AC036136.2, AC023395.2, AC012264.8, AC022330.9, AC053477.2, AC023347.3, AC018461.18, AC027820.2, AC032036.2, AC026737.3, AC026704.3, AC022418.3, AC010369.5, AC010230.3, AC0I0396.3, AC008780.4, AC009051.5, AC009050.4, AC027780.2, AC027630.4, AC060807.1, AC027168.2, AC009614.4, AC017106.3, AC026590.2, AC027646.3, AC040964.1, AC015972.3, AC025790.2, AC011080.2, AC022247.2, AC024026.2, AC016686.4, AC024403.2, AC018408.1, AC013404.1, AC010874.2, AC012545.1, AL157771.3, AL139815.3, AL139275.6, AL139274.6, AL136380.2, AL355820.2, AL355886.1, AL354929.1, AL162453.4, AL096870.1, AL157818.2, AP002001.1, AP001985.1, AP001388.1, AP001241.1, AP001230.1,

SEQ ID NO. 125
NGO-Br-40
MK353/T3 5'

NM_004120.2, M55543.1, NM_002053.1, M55542.1, AK001823.1, NM_010259.1, M63961.1, M55544.1, NM_0102601 AF109168.1, AF077007.1, AJ007970.1, M80367.1, AC004930.1, NC_001143.1, NM_000379.1, AC005669.1, AL121654.1, U39487.1, Z28127.1, X72016.1, U06117.1, D10044.1, D11456.1, NM_0015672 AC007048.4, AC005917.2, AC024882.1, AE003603.1, AE003479.1, NM_006460.1, AF202730.1, AC002565.1, AC008125.9, AC007785.1, AF125463.1, AL163210.2, AL135749.2, AL132880.2, AL161581.2, AL161516.2, AL117204.1, Z81088.1, AL078588.9, AL117193.1, AL034449.1, AL049487.1, AL034567.1, I26818.1, X15209.1, X15750.1, Y14385.1, AB021179.1, AW820994.1, AW804484.1, AI902944.1, AW468007.1, AI969542.1, AW804456.1, AW821048.1, AI922648.1, AI859339.1, AI500511.1, AW577433.1, AI906045.1, AI251115.1, AA131850.1, AW578905.1, AA044192.1, AW861558.1, AW797814.1, AW797815.1, AA471169.1, AI683358.1, AA586545.1, AW001215.1, AW793466.1, AA164464.1, AI989871.1, AW474.4,40.1, AI683206.1, AA075671.1, AI830004.1, AI811907.1, AW797793.1, H05350.1, AW058212.1, AI983562.1, AA876142.1, AA486849.1, F06345.1, AI439472.1, AA174655.1, AW373870.1, AW804431.1, AW817431.1, AA487747.1, P23076.1, AI905784.1, AI905719.1, AA610352.1, AW609821.1, AA044017.1, AI760378.1, AA487367.1, AW078537.1, W37973.1, P07031.1, AW614912.1, I29528.1, T87056.1, W37972.1, AI492530.1, AA263171.1, F05698.1, AI865686.1, AI386222.1, M180927.1, AI036133.1, AA184762.1, AA153027.1, AA153021.1, AW515880.1, AW362711.1, AW400386.1, AV362793.1, AW363341.1, AI075062.1, AA487528.1, AA424397.1, AA315174.1, AA294979.1, AA057242.1, T41892.1, AL161639.4, AL160008.1, AL139416.1, AL138786.3, AL355818.2, AC021689.2, AL138889.2, AL136985.1, AC024150.5, AC024038.5, AC019071.2, AC010743.4, AP001809.1, AC009770.4, AC023395.2, AC036.1, 29.2, AC027820.2, AC035140.2, AC008373.6, AC010630.3, AC008731.4, AC063979.1, AC017106.3, AC040911.1, AC024047.2, AC027362.1, AC012241.4, AC015975.3,

TABLE 1-continued

Sequence homologies (GenBank Accession Numbers)

AC006295.8, AC013759.2, AC017228.1, AC015394.1, AF166490.1, AC006916.1, AC006719.1, AL121796.4, AL353796.2, AL022594.18, AL035066.20, Z98858.1, Z98855.1, AL021573.1, AP001385.1, AP001157.1, AP000812.1, AP000593.1, AP000485.2,
SEQ ID NO. 126
NGO-Br-40
MK451/T3 5'

NM_004120.2, M55543.1, M80367.1, NM_010259.1, M63961.1, M55544.1, NM_010260.1, AF109168.1, AF077007.1, AJ007970.1, NM_002053.1, M55542.1, AK001823.1, AC004930.1, AF085699.1, AC007980.1, AL109935.39, X77129.1, Z95388.1, AB015429.1, AB020867.1, AC005103.3, NM_013134.1, NM_006460.1, U44731.1, AF047825.1, AC004798.1, AC003111.1, AB021179.1, M29249.1, AI906045.1, AA131850.1, AW368079.1, AW362711.1, AW815880.1, W72748.1, AW297239.1, AW820994.1, W77927.1, AI902944.1, AW861558.1, AW578905.1, AA878690.1, H05350.1, AA044192.1, AA486849.1, F06345.1, AI905784.1, AI905719.1, AI528561.1, AA911189.1, F07031.1, AI962517.1, AA873192.1, AW474440.1, AW820809.1, AA487747.1, AI989871.1, AA487367.1, AA164464.1, AI683358.1, AI683206.1, AW320458.1, T83604.1, T75545.1, AW817439.1, AW609764.1, AW211765.1, AW817360.1, AA122936.1, AW821048.1, AW804484.1, AW804456.1, AW106727.1, AW804431.1, AI811907.1, AI922921.1, AA174655.1, AA848004.1, AA5 06001.1, AW468007.1, AV362793.1, AA582749.1, W13273.1, AI651570.1, AA880099.1, AW665096.1, AW454822.1, AW166154.1, AI811680.1, M796944.1, AV046437.2, AA955194.1, AI383864.1, AI216433.1, AA928789.1, AA927260.1, AA909971.1, AA890309.1, AA719024.1, C77542.1, AA514692.1, AA099506.1, N33318.1, N21081.1, H16325.1, Z44502.1, AL161639.4, AL160008.1, AL139416.1, AL138786.3, AC034166.2, AC016696.4, AL158849.7, AC036129.2, AC018354.6, AC012053.2, A0021689.2, AC024047.2, AC026047.2, AC024303.2, AC020883.2, AC006295.8, AF166490.1, AL356008.1, AL161658.3,
SEQ ID NO. 127
NGO-Br-41
MK264/T3 5'

NM_004602.1, AF061941.1, AF061940.1, AF061939.1, AF061938.1, AJ132258.1, NM_011490.1, AF061942.1, NM_007344.1, X83973.1, AC004585.1, NM_014865.1, NM_014393.1, AC004002.1, AC007542.2, AF038608.1, AC006064.9, U32712.1, AL121877.13, Y19062.1, AK002152.1, AK001576.1, X67320.1, AB015752.1, M31229.1, L04287.1, L03711.1, X68492.1, D63880.1, AC006142.1, AC010186.6, AC008078.1,1, AC004131.1, U46596.1, AL121775.2, AL096802.11, AL034345.3, X89870.1, AP000497.1, AW351909.1, AW403841.1, AW836710.1, AW320695.1, AA240112.1, AA218774.1, AA270608.1, AW351905.1, AW141293.1, AA135261.1, U69197.1, H17179.1, T31173.1, T31172.1, AW581619.1, AA153656.1, T74327.1, W28253.1, AL045575.1, AA191685.1, R95466.1, AA209495.1, T06248.1, AA025528.1, AA285302.1, AW366804.1, AW153775.1, AI958903.1, AJ244015.1, M386266.1, AI326431.1, AA562089.1, AA104976.1, W82776.1, AI353217.1, AA813637.1, AA700898.1, AV182864.1, AA918411.1, AA890493.1, U25927.1, AV398409.1, AV344143.1, AW123407.1, AA388686.1, AA156216.1, AL133174.11, AC063967.1, AC055879.1, AC011492.5, AC051627.3, AC068845.1, AC016960.6, AC015624.2, AC069023.1, AC027538.2, AC025512.2, AC022909.4, AC015944.3, AC009842.7, AC015989.3, AC015809.2, AC022403.3, AC023263.2, AC012595.3, AC012161.7, AC006739.1, AL355854.1, AL160399.2, AU 57885.2, AP001397.1,
SEQ ID NO. 128
NGO-Br-41
MK264/T7 3'

AJ132258.1, NM_004602.1, AF061941.1, AF061940.1, AF061939.1, AF061938.1, AL109755.14, NM_011490.1, AF061942.1, AL163222.2, AP001677.1, AP000946.3, AC006717.1, AF196972.1, AE001740.1, AC005318.1, Z81142.1, AL031007.1, X06997.1, AC024077.2, AC007559.3, AC004988.2, AF134199.1, AC005520.2, AC006518.17, AF063866.1, AE001142.1, AC005544.1, U47023.1, AF076274.1, AC004051.1, AC005337.1, AC004100.1, AL161946.1, AL161499.2, AL050326.3, AL022722.1, AB019438.1, L00608.1, L00607.1, L06312.1, L06135.1, X57002.1, X60725.1, X57001.1, X69496.1, D37813.1, AB009052.1, Y10614.1, AI983007.1, AI802592.1, AI190464.1, U69197.1, AA889669.1, AA157806.1, AI925182.1, AA846829.1, AA191622.1, AA609322.1, AA910279.1, AI333376.1, H16250.1, AA034036.1, AI557117.1, H11397.1, N45294.1, AW169049.1, AA907298.1, AI819766.1, N71642.1, AW263961.1, T15527.1, AI362641.1, AI472734.1, T89105.1, AI433939.1, AW183696.1, AA931425.1, AA594141.1, AA847184.1, AW105669.1, AA658226.1, AI419995.1, AW194431.1, AI340359.1, AA160287.1, N22707.1, AW576192.1, AI740524.1, AI017580.1, AL044093.1, AA858303.1, AA610333.1, AL044094.1, AI803720.1, AW166420.1, AW069464.1, AA903241.1, AI864144.1, AI216722.1, AI921819.1, AI190687.1, AA074277.1, N51259.1, F10050.1, AA427905.1, AI814813.1, AA541311.1, H96787.1, AA904093.1, AA669068.1, AA206434.1, AI268881.1, AI150891.1, AI061243.1, AA747271.1, AA135198.1, AA593048.1, AA135111.1, AA207148.1, Z41528.1, AA135106.1, AW272442.1, AI963361.1, AW090441.1, AL262450.1, AA043331.1, T10553.1, T11277.1, AI138341.1, N66837.1, AI383429.1, N67513.1, N31181.1, D20243.1, AI868926.1, AA886271.1, AA578579.1, AW384062.1, AI160470.1, AA043332.1, AI687569.1, AI970644.1, T94064.1, AI799396.1, AA620459.1, AA741223.1, AA090084.1, AW464265.1, AL133174.11, AC011492.5, AL158850.2, AC063967.1, AC068736.1, AC009429.3, AC067887.2, AC024935.8, AC026678.4, AC021057.3, AC021056.3, AC025928.2, AC015929.4, AC013364.7, AC025738.1, AC022049.3, AC017061.3, AC021682.1, AL158840.4, AL133284.12, AC026333.2, AC013625.3, AC009047.4, AC012215.3, AC027402.2, AC007383.3, AC055805.1, AC019088.3, AC026588.2, AC015825.4, AC021186.2, AC022903.3, AC024732.2, AC015834.3, AC021011.2, AC022820.2, AC016930.5, AC010974.4, AC021980.1, AC009642.2, AC005282.1, AL139084.4, AL353709.1, AL354723.1, AP001394.1,
SEQ ID NO. 129
NGO-Br-42 combined AC005069.2, AB011102.1, L23077.1, NM_013889.1, AF017806.1, AP001253.1, AE001788.1, AL133417.10, AF262044.1, AC008051.3, AF237670.1, AC021043.4, AF022974.1, L14730.1, AL031056.1, Z83313.1, AP001426.1, X01441.1, AB017192.1, AP000606.1, AB025611.1, AB018115.1, AL134426.1, AA972711.1, AW157207.1, AW770787.1, AW468156.1, AW473852.1, AI266259.1, AA599244.1, AI817665.1, AA837101.1, AI377803.1, AW163183.1, AA527031.1, AA721095.1, N33849.1, AA167375.1, AI572106.1, AI251893.1, AI241041.1, H84943.1, AA279430.1, AW609920.1, AA764886.1, AI699744.1, AA725331.1, AI302964.1, AI567039.1, AW379942.1, AI593485.1, D52427.1, D55742.1, AI956843.1, AA210577.1, T10410.1, C01624.1, AA165991.1, AA825378.1, AI642382.1, AA611337.1, AW214633.1, AI551647.1, AW489266.1, AI467091.1, N85349.1, AA473146.1, AA167374.1, D55908.1, AA471246.1,

TABLE 1-continued

Sequence homologies (GenBank Accession Numbers)

AI956621.1, AI606224.1, AA726787.1, R98544.1, AA292113.1, AA279626.1, AW385669.1, W45824.1, AI810043.1,
H33984.1, R11996.1, AW416485.1, AV403226.1, AW260960.1, AW222072.1, AV227797.1, AW077780.1, AI820616.1,
AV061748.1, AV042292.2, AI632719.1, AI423781.1, AI395491.1, AI014647.1, AA918760.1, AA829983.1, AA395972.1,
AA363407.1, AA274077.1, AL139274.6, AL160258.3, AL137180.3, AL138875.3, AL137000.3, AC025451.3,
AC023608.1, AC023276.3, AC068334.1, AC027596.2, AC008276.2, AC006451.2, AC019240.4, AC005308.6,
AC010109.4, AC014418.1, AL138727.2,
SEQ IDNO. 130
NGO-Br-42
MK182/T3 5'

AC005069.2, AB011102.1, L23077.1, NM_013889.1, AF017806.1, AL133417.10, AC004485.1, AC008082.12,
AF022974.1, AE003628.1, AE003579.1, AE003420.1, AC012654.2, AC000096.13, AC005137.1, AC003063.7,
AC016163.4, AC006317.3, AC004973.1, AC007649.12, AC005454.1, AL132976.2, AL122126.2, AC000392.1,
AL121806.2, Z69838.1, AL022722.1, AL049571.1, U64875.1, AI000521.1, D89336.1, AW163183.1, N33849.1,
H84943.1, AA721095.1, AL134426.1, AI642382.1, AA611337.1, AA972711.1, AW609920.1, AW157207.1, AW770787.1,
AA726787.1, AI266259.1, AI817665.1, AA837101.1, AA167375.1, N85349.1, AW473852.1, AI699744.1, AI251893.1,
AW468156.1, AI572106.1, AA825378.1, AA764886.1, AA599244.1, AA165991.1, AA279626.1, AI956843.1, AI593485.1,
AI942680.1, AV403226.1, AW334920.1, AW214633.1, AV227797.1, AW077780.1, AI820616.1, AI014647.1,
AL139274.6, AL137180.3, AL160258.3, AC067751.1, AC026297.2, AC022907.3, AC016212.3, AC023608.1,
AC069075.1, AC068778.3, AC044835.2, AC023276.3, AC069019.1, AC021870.6, AC068334.1, AC008276.2,
AC053489.1, AC021598.4, AC024718.3, AC019240.4, AC024646.2, AC005308.6, AC018580.4, AC024632.1,
AC018519.3, AL158166.6, AL158158.4, AL157393.1,
SEQ ID NO. 131
NGO-Br-42
MK182/T7 3'

AC005069.2, AB011102.1, L23077.1, NM_013889.1, AF017806.1, AL163231.2, AP001686.1, AP001253.1, AE001788.1,
AF262044.1, AF237670.1, AC021043.4, AE003478.1, AF229187.1, AC004658.1, AL163276.2, AL118512.8, L14730.1,
Z83313.1, AP001731.1, AP001426.1, X01441.1, AB017192.1, AP000163.1, AB025611.1, AP000021.2, NC_001136.2,
AC009415.2, AE003824.1, AC004460.1, NM_011261.1, AC008072.3, AC005046.3, AF115517.1, AC005467.1, U24703.1,
AE000943.1, AL049834.3, AL049546.3, Z93374.1, AL021939.1, Z74123.1, X51895.1, Z78583.1, D63520.1,
AW157207.1, AA972711.1, AW770787.1, AW468156.1, AI266259.1, AA599244.1, AI377803.1, AA527031.1,
AI572106.1, AA279430.1, AA725331.1, AI302964.1, AI567039.1, AW379942.1, D52427.1, D55742.1, AI593485.1,
AI956843.1, T10410.1, AA210577.1, C01624.1, AA165991.1, AW214633.1, AI551647.1, AW489266.1, AI467091.1,
AA473146.1, D55908.1, AI606224.1, AW163183.1, R98544.1, AA292113.1, AW385669.1, W45824.1, AI810043.1,
H33984.1, R21996.1, AW222072.1, AI632719.1, AI423781.1, AA829983.1, AA395972.1, AA274077.1, AA030373.1,
W20048.1, AL139274.6, AL137180.3, AL160258.3, AL138875.3, AL137000.3, AC027490.3, AC025451.3, AC010432.4,
AL137249.6, AC069145.1, AC069071.1, AC018473.9, AC006451.2, AC027189.2, AC023844.2, AC021677.3,
AC010109.4, AL135932.4, AL137013.3, AC041025.2, AC012211.3, AC027600.1, AC024254.2, AC024026.2,
AC023153.2, AC012369.2, AC018873.1, AF188032.1, AL139418.1, AP001813.1,
SEQ ID NO. 132
NGO-Br-42
MK203/T3 5'

AC005069.2, AB011102.1, L23077.1, NM_013889.1, AF017806.1, AC016678.4, AE003694.1, AE003528.1, AF063866.1,
AP000606.1, AB018115.1, AC016749.4, AC019209.3, AE003706.1, AE003579.1, AE003462.1, AF240628.1,
AC011284.3, AF224669.1, AC006317.3, AC005534.2, AC003037.1, U70823.1, AC004642.1, AL163224.2, AL049588.11,
AL161516.2, AL161514.2, AL117386.1, AL078599.19, AL035693.19, Z81089.1, Z69838.1, Z95329.1, AL022722.1,
AL035090.10, AP001679.1, AL049571.1, U64875.1, AJ000521.1, AL049482.1, I23820.1, I23819.1, AP001251.1,
M76616.1, X61589.1, D89336.1, AP000001.1, AL134426.1, AW473852.1, AA837101.1, AI817665.1, AA721095.1,
AA167375.1, AI251893.1, AW609920.1, AI241041.1, AA764886.1, N33849.1, AI699744.1, H84943.1, AW163183.1,
AA825378.1, N85349.1, AI642382.1, AA611337.1, AA279626.1, AV424771.1, AW416485.1, AW260960.1, AV061748.1,
AV042292.2, AU39274.6, AL160258.3, AL137180.3, AC026297.2, AC025494.2, AL109926.2, AC027596.2,
AC020987.4, AC023957.3, AC016187.4, AC062033.1, AC025104.2, AC025526.2, AC022744.2, AC024632.1,
AC022691.1, AC009818.4, AC010204.8, AC008250.15, AC020418.1, AC009588.4, AC012259.2, AC014418.1,
AC007692.3,
SEQ ID NO. 133
NGO-Br-42
MK2410/T3 5'

AC005069.2, AB011102.1, I230771 NM_013889.1, AF017806.1, AC016678.4, AE003694.1, AF063866.1, AL049874.3,
AP000606.1, AB018115.1, NC_001134.1, AC016749.4, AE003831.1, AE003528.1, AC011284.3, AF224.669.1, U91318.1,
AC006317.3, AC006004.1, AC005534.2, AC006221.1, U17503.1, U70823.1, AL049588.11, AL133512.10, Z69838.1,
Z95329.1, AL035090.10, I23820.1, I23819.1, Z36160.1, X76053.1, AB020865.1, M76616.1, X61589.1, AP000001.1,
AL134426.1, AW473852.1, AA837101.1, AI817665.1, AA167375.1, AI241041.1, AI251893.1, AA721095.1,
AW609920.1, AA764886.1, AI699744.1, AA825378.1, N85349.1, N33849.1, AA167374.1, AA471246.1, H84943.1,
AI956621.1, AW163183.1, AI642382.1, AA611337.1, AV042292.2, AW646457.1, AW642567.1, AW416485.1,
AW260960.1, AV061748.1, AI395491.1, AL139274.6, AL160258.3, AL137180.3, AL139223.2, AC016904.2,
AC026297.2, AC025494.2, AC016469.4, AC012219.3, AC020987.4, AC023957.3, AC016187.4, AC025104.2,
AC009818.4, AC010204.8, AC008250.15, AC020418.1, AC012259.2, AC007692.3, AL157389.3, AC037489.2,
AC015846.3, AC037434.2, AF267167.1, AC023156.3, AC010543.4, AC009128.5, AC007716.2, AC009547.3,
AC010902.3, AC019171.3, AC008271.3, AC018797.3, AC062007.1, AC026829.2, AC025656.2, AF235099.1,
AC026225.2, AC025660.2, AC009562.5, AC021619.3, AC016667.2, AC007413.4, AC007330.5, AC012182.3,
AC025348.1, AC010894.3, AC011564.3, AC014418.1, AC013270.2, AC014124.1, AC010826.2, AC007414.4,
AL162579.4, AL161647.5, AL157779.4, AL136311.3, AL355312.3, AL354893.3, AL136319.7, AL354711.1, AL157836.3,
AL122125.1, AP001448.1, AP001023.1, AP000813.1, AP000675.1, AP000624.1,

TABLE 1-continued

Sequence homologies (GenBank Accession Numbers)

SEQ ID NO. 134
NGO-Br-42
MK2410/T7 3'

AC005069.2, AB011102.1, L23077.1, NM_013889.1, AF017806.1, AL163231.2, AP001686.1, AP001253.1, AF262044.1, AF237670.1, AC021043.4, AE003478.1, AF229187.1, AC008072.3, AC004658.1, AL163276.2, AL118512.8, L14730.1, Z83313.1, AP001731.1, AP001426.1, X01441.1, AB017192.1, AP000163.1, AB025611.1, AP0000212 NC_001136.2, AC009415.2, AC004460.1, AC005046.3, AF115517.1, AL049834.3, AL049546.3, Z93374.1, AL021939.1, Z74123.1, D00702.1, X51895.1, Z78583.1, AW157207.1, AA972711.1, AW468156.1, AW770787.1, AI266259.1, AA599244.1, AI377803.1, AA527031.1, AI572106.1, AA279430.1, AA725331.1, AI302964.1, AI567039.1, AW379942.1, D55742.1, T10410.1, D52427.1, AI593485.1, AI956843.1, C01624.1, AA210577.1, AA165991.1, AW214633.1, AI551647.1, AW489266.1, AI467091.1, AA473146.1, D55908.1, AW163183.1, AI606224.1, R98544.1, AA292113.1, AW385669.1, AW061815.1, H33984.1, R21996.1, AW728990.1, AW222072.1, AI810043.1, AI632719.1, AI423781.1, AA829983.1, AA030373.1, AL139274.6, AL137180.3, AL160258.3, AL138875.3, AL137000.3, AC027490.3, AC025451.3, AC010432.4, AL137249.6, AC069145.1, AC019230.3, AC034127.2, AC024687.3, AC006451.2, AC027189.2, AC020695.3, AC009407.3, AC021677.3, AC023095.2, AC010109.4, AC019599.1, AL135932.4, AL137013.3, AC069071.1, AC024223.7, AC018473.9, AC012323.4, AC024272.2, AC044797.2, AC027215.2, AC034298.1, AC016350.3, AC016031.2, AC027600.1, AC024254.2, AC024026.2, AC011272.3, AC023153.2, AC013409.3, AC012369.2, AC011231.3, AC011619.2, AC016407.1, AF188032.1, AL121943.13, AI253786.2, AL161417.5, AL139418.1, AP001813.1,
SEQ ID NO. 135
NGO-Br-42
MK245/T7 3'

AC005069.2, AB011102.1, I230771 NM_013889.1, AF017806.1, AL163231.2, AP001686.1, AP001253.1, AF262044.1, AF237670.1, AC021043.4, AE003478.1, AF229187.1, NM_011692.1, AC004901.1, U96760.1, AC004658.1, AL163276.2, AL118512.8, L14730.1, Z83313.1, X01441.1, AP001731.1, AP001426.1, AB017192.1, AP000163.1, AB025611.1, AP000021.2, AC005046.3, AC007887.8, AL032637.1, Z78016.1, AL031825.1, AL049546.3, AL031644.1, Z93374.1, AL021939.1, Z74123.1, Z68252.1, X51895.1, Z78583.1, AA972711.1, AW157207.1, AW468156.1, AW770787.1, AI266259.1, AA599244.1, AI377803.1, AA527031.1, AI572106.1, AA279430.1, AA725331.1, AI302964.1, AW379942.1, AI567039.1, AI593485.1, D52427.1, D55742.1, AI956843.1, T10410.1, AA210577.1, C01624.1, AA165991.1, AW214633.1, AI551647.1, AW489266.1, AI467091.1, AA473146.1, D55908.1, AW163183.1, AI606224.1, R98544.1, AA726787.1, W45824.1, AI942680.1, H33984.1, R21996.1, AI632719.1, AI423781.1, AA829983.1, AA030373.1, AL139274.6, AL137180.3, AL160258.3, AL138875.3, AL137000.3, AC027490.3, AL137249.7, AC069145.1, AC018473.10, AC069071.2, AC025451.3, AC010432.4, AC006451.2, AC021677.3, AC010109.4, AC019599.1, AL135932.4, AL137013.3, AL138725.4, AC012014.5, AC012323.4, AC024272.2, AC044797.2, AC027215.2, AC016350.3, AC027600.1, AC024254.2, AC024026.2, AC016878.3, AC011272.3, AC012369.2, AF188032.1, AL157936.3, AU39418.1, AP001813.1, AP001198.1,
SEQ ID NO. 136
NGO-Br-43

AB023420.1, L12723.1, X67643.1, AF077354.1, NM_008300.1, D85904.1, X67641.1, X67642.1, X67640.1, AC011013.17, U23921.1, NM_014278.1, AB023421.1, MM 011020.1, AW69482.1, AB001926.1, NM_006644.1, AF039695.1, AB003334.1, AB003333.1, D86956.1, Z47807.1, NM_013559.1, L40406.1, D67017.1, D67016.1, AB005279.1, AE003433.1, AC010072.5, AC004674.1, AL078621.19, AL096821.2, Z71263.1, Y13478.1, AC008545.3, AC011751.2, AC009489.3, AE003820.1, AE003518.1, M96150.1, AC007453.1, AC006409.2, AC006502.2, AC002350.1, AC003006.1, AJ121904.13, AL135879.1, AL132994.2, AL121790.2, AL133003.1, AL133033.1, AJ251914.1, Z73907.1, AL008713.1, AL034348.5, AL034551.14, AL033522.1, AL008628.1, AP000555.1, AB028948.1, AL135032.1, AW609809.1, AW391888.1, AW609816.1, AW817219.1, AI567970.1, AW578992.1, AI925201.1, AW363570.1, AW085727.1, AI188118.1, AI560115.1, AI754819.1, AI956648.1, AA493400.1, AW754210.1, AA191559.1, AA173193.1, AW367717.1, AW583074.1, M907727.1, AI627184.1, AW513086.1, AI952125.1, AW609784.1, AW192860.1, AW489091.1, AW578990.1, AA205597.1, AI274739.1, AI014766.1, AA913650.1, AW363562.1, AI230094.1, AI140781.1, AI375447.1, AI983708.1, W74245.1, AW613658.1, AA913187.1, AA633656.1, AA162193.1, AI678576.1, AW817504.1, AA518224.1, AA210820.1, AW819755.1, AA216635.1, AI866008.1, AA354293.1, AA874242.1, AA761335.1, AA103602.1, AW545353.1, AA227204.1, AW545094.1, AW537735.1, AA991908.1, AW819997.1, AW578928.1, AW262251.1, AI408846.1, AW542227.1, AA125191.1, AA437859.1, AA821679.1, AW754207.1, AA542289.1, AA121736.1, AA591244.1, AW861588.1, AI909282.1, N50726.1, AW582514.1, AI956869.1, AW196018.1, AW609842.1, AW372094.1, AI799801.1, AW817153.1, AW609769.1, AW582510.1, AW817315.1, AW371571.1, AW817164.1, AW817496.1, AW817372.1, AW582499.1, AW391901.1, AW381775.1, AA870633.1, AA498893.1, AA687763.1, AW817440.1, AW371552.1, AW371548.1, R11513.1, AW817445.1, AI314009.1, AI760838.1, AC020834.2, AC015501.3, AC021286.3, AC022550.1, AL137142.8, AC048384.2, AC065723.1, AC063302.1, AC039237.1, AC034727.1, AC034094.1, AC025168.3, AC013883.1, AL135795.3, AL160402.2, AL121814.1, AC034304.2, AC021076.3, AC036128.2, AC068226.1, AC025689.3, AC067810.1, AC027184.2, AC017102.5, AC023692.2, AC018288.1, AL121956.4, AL138965.3,
SEQ ID NO. 137
NGO-Br.43
MK132/T3 5'

AB023420.1, L12723.1, X67643.1, AF077354.1, NM_008300.1, D85904.1, NM_006644.1, AF039695.1, AB003334.1, AB003333.1, D86956.1, NM_0142781 NM_011020.1, U23921.1, AB023421.1, D49482.1, AB001926.1, U81260.1, AJ132792.1, NM_013559.1, AE003820.1, AE003518.1, AC007453.1, AC006409.2, U76309.1, AL121775.2, AL133033.1, AL034348.5, AL034551.14, AL008628.1, L40406.1, AP000555.1, AB028948.1, D67017.1, D67016.1, AF245116.1, AC008865.3, AC007171.4, AC006200.2, AC006624.1, NM_013513.1, AE003750.1, AE003571.1, AC011809.2, AC012380.1, AC011198.2, U78296.2, AF106589.1, Y14213.1, AL078594.36, Z70757.1, Z77657.1, AL049861.18, AL115647.1, AL113847.1, AL111874.1, U04056.1, U04055.1, U03487.1, AB005279.1, AB005275.1, U00035.1, M57719.1, L35933.1, X56682.1, M59962.1, AW578992.1, AW363570.1, AW609809.1, AW391888.1, AW609816.1, AW817219.1, AW367717.1, AW578990.1, AA191559.1, AW363562.1, AW583074.1, AL135032.1, AW609784.1,

TABLE 1-continued

Sequence homologies (GenBank Accession Numbers)

AI909282.1, AI907727.1, AW754210.1, AW817504.1, AA626524.1, 29047.1, AA370218.1, W26511.1, AA755774.1,
AW817215.1, AA125191.1, AW609842.1, AW817153.1, AW609769.1, AW582510.1, AW582514.1, AW817164.1,
AW817496.1, AW817440.1, AW817372.1, AW817318.1, AW817315.1, AW817234.1, AW582499.1, AW391901.1,
AW381775.1, AW372094.1, AW371556.1, AW371553.1, AW371550.1, AW817445.1, AW817442.1, AW601252.1,
AW582504.1, AW371571.1, AW371552.1, AW371548.1, AW817364.1, AW817319.1, AA543642.1, AA437859.1,
AW371570.1, AW817432.1, AW372116.1, AW819755.1, AW374305.1, AW609807.1, AW371549.1,
AW609846.1, AW578928.1, AW609867.1, AW609856.1, AA518224.1, AW609844.1, AW384296.1, AI760838.1,
AA870633.1, AA117945.1, AI956648.1, AW748834.1, AI827505.1, D29434.1, AA615363.1, AA445826.1, AJ396671.1,
AW819997.1, W22433.1, AW839103.1, AA874242.1, AW754207.1, AA103602.1, AW125594.1, AA919208.1,
AW366794.1, AW371561.1, AI314009.1, R54223.1, AW371568.1, AI567970.1, AW861588.1, AW229772.1, AA645750.1,
AA212025.1, AA821679.1, AV312929.1, AW391883.1, AC020834.2, AL137142.8, AC027421.2, AC025860.2,
AC055864.2, AC065723.1, AC0633021, AC039237.1, AC034727.1, AC034094.1, AC022301.6, AC068812.8,
AC012157.9, AC034304.2, AC009781.5, AC009321.5, AC023056.7, AC027672.3, AC025689.3, AC027184.2,
AC016065.4, AC009899.5, AC010563.3, AC013243.4, AC018288.1, AC015160.1, AC005450.4, AL356425.1,
AL356303.2, AL121589.12, AC002417.1, AL139108.2, AP001180.1,
SEQ ID NO. 138
NGO-Br-43
MK132/T7 3'

AB023420.1, NM_008300.1, D85904.1, AF077354.1, X67643.1, L12723.1, NM_011020.1, U23921.1, D49482.1,
AB001926.1, AC010072.5, Z71263.1, AC009489.3, AC024817.1, AE003641.1, AE003408.1, AC012039.10, AC004614.1,
AF164299.1, NM_008229.1, AC006355.3, AF071221.1, AC007172.2, AC005856.1, AC005495.1, AC004671.1, U31758.1,
AE010I6.1, AL031853.1, AL023804.1, X59603.1, L39125.1, D01021.1, AI567970.1, AI925201.1, AW085727.1,
AI188118.1, AI560115.1, AI754819.1, AA493400.1, AA173193.1, AI627184.1, AW513086.1, AI952125.1, AWI92860.1,
AA205597.1, AI274739.1, AI014766.1, AA913650.1, AI140781.1, AI375447.1, AI983708.1, AW613658.1, AA913187.1,
AA633656.1, AI678576.1, AA210820.1, AA216635.1, AI866008.1, AA761335.1, AW545353.1, AA227204.1,
AW754210.1, AW545094.1, AW537735.1, AA991908.1 AW262251.1, AI408846.1, AW542227.1, AW819755.1,
AW819997.1, AW861588.1, N50726.1, AI956869.1, AW196018.1, AI799801.1, AW578928.1, AA687763.1, C76500.1,
AW529607.1, R11513.1, AW754207.1, R54223.1, AA061925.1, C81619.1, AW604699.1, AI347806.1, AA558925.1,
AI593463.1, AA179753.1, AA542420.1, AW682076.1, AU020108.1, W27793.1, C81004.1, AA180330.1, AA121181.1,
Z18817.1, AA823019.1, AI911599.1, AW060626.1, R60452.1, AW583074.1, AI197516.1, AA935133.1, AU015665.1,
AA671121.1, AW604696.1, AW366794.1, AI760838.1, N74649.1, AW071627.1, AA408319.1, AA407913.1, AI501198.1,
AA799083.1, AA543635.1, AW213908.1, AI576267.1, AV165705.1, AA434598.1, AA703912.1, AW071628.1,
AV294079.1, AW754208.1, N79564.1, AW371893.1, AA655993.1, R56469.1, AI569348.1, AA948300.1, AI655547.1,
AV301839.1, AC048384.2, AC002518.1, AL160402.2, AC068975.1, AC026382.3, AC020551.2, AC021393.2,
AL353725.3, AL354926.1, AC018920.5, AC046135.4, AC064821.2, AC025511.2, AC026745.3, AC010464.4,
AC036128.2, AC021573.4, AC068383.1, AC066588.1, AC027012.2, AC018990.4, AC026061.2, AC021717.3,
AC024037.2, AC015653.3, AC019002.3, AC022038.2, AC017901.1, AC006911.1, AL121834.8, AL160290.3,
AL157819.2,
SEQ ID NO. 139
NGO-Br-43
MK261/T3 5'

AB023420.1, X67643.1, L12723.1, NM_008300.1, AF077354.1, D85904.1, X67641.1, X67642.1, AC011013.17,
U23921.1, NM_014278.1, AB023421.1, NM_0110201 D49482.1, AB001926.1, AL132776.11, AL078621.19, Y13478.1,
AC011751.2, AC009489.3, AC006502.2, AC002350.1, AC003006.1, AL135879.1, AL121790.2, AC007244.2,
AC0I9183.3, AC0I0361.3, AC011292.2, AF248484.1, NM_014004.1, AC003984.1, AC002460.1,
AC004612.1, AC004822.1, AC006322.2, AC004988.2, AC00505O.2, AC008173.2, AC004772.1, AC005406.2,
AC006559.6, AC009248.6, AC008071.2, AC007794.1, AF101874.2, AF064254.1, AC003689.1, AC003678.1,
AF068862.1, AC004075.1, AC004043.1, U01882.1, AL163207.2, Z72001.1, AL160192.2, AL049555.6, AL078595.12,
U50871.1, AL035661.16, AL080316.8, AL050334.12, AL109854.10, AL096802.1,1, Z68873.1, AL031000.1, AL023806.1,
Z97987.1, Z98748.1, Z84477.1, AL021307.1, L40406.1, AP001065.1, D67017.1, D67016.1, W74245.1, AL121736.1,
AA542289.1, AA591244.1, AA498893.1, AA354293.1, AA162193.1, AI314009.1, AW489091.1, N85657.1, AI956648.1,
AI230094.1, R56974.1, AW561596.1, AV226442.1, AV226379.1, AA063966.1, AA821679.1, AA896038.1, AL135032.1,
AA874242.1, AW578931.1, AW578926.1, AA103602.1, AA518224.1, AA499765.1, AA385978.1, AV320109.1,
AA121221.1, AV226463.1, H93522.1, AA247166.1, W20649.1, AI956324.1, AW385268.1, AW385266.1, AI396671.1,
AW502280.1, AW501910.1, AW501774.1, AW274501.1, AU037061.1, AI085867.1, AA747312.1, AA102000.1,
H23069.1, H10565.1, AC020834.2, AC015501.3, AC021286.3, AL355143.4, AC025168.3, AC016767.3, AL353608.2,
AL135795.3, AC036128.2, AC010814.5, AC017022.3, AC022968.2, AC022760.2, AC009875.2, AL353625.2,
AL121956.4, AP001587.1, AC021053.7, AC018474.9, AC034305.2, AC068992.3, AC040969.2, AC040965.2,
AC040960.2, AC023410.3, AC023538.2, AC026698.3, AC025182.2, AC024569.2, AC022433.3, AC022430.3,
AC022135.3, AC008773.6, AC008968.4, AC010234.3, AC011346.3, AC008673.6, AC021595.3, AC062017.2,
AC023116.4, AC0I0133.2, AC058804.1, AC018978.5, AC040961.1, AC026493.3, AC021464.2, AC023858.2,
AC021948.3, AC018443.5, AC016763.5, AC021208.3, AC015823.3, AC022039.2, AC023560.2, AC009666.4,
AC024010.2, AC010895.3, AC012669.2, AC021319.1, AC012502.2, AC013259.1, AL139375.7, AL355345.2,
AL139803.7, AL136087.6, AL158147.4, AL354875.3, AL138702.5, AL353151.2, AL162492.3, AL034378.2, AP001986.1,
AP001828.1,
SEQ ID NO. 140
NGO-Br-43
MK2912/T3 5'

AB023420.1, X67643.1, L12723.1, AF077354.1, NM_008300.1, D85904.1, X67641.1, X67640.1, AC011013.17,
X67642.1, U23921.1 NM_014278.1, AB023421.1, NM_011020.1, D49482.1, AB001926.1, AL078621.19, AL096821.2,
Y13478.1, NM_006644.1, AC004003.1, AF039695.1, AP117829.1, AF069291.1, AC002350.1, AB003334.1, AB003333.1,
D86956.1, L43098.1, L43082.1, AC010352.4, AC007730.2, AC007662.2, AF240629.1, AF123535.1, AC002124.1,
AF130247.2, AC005228.1, AC009248.6, AF081491.1, AF081490.1, AF081489.1, AF081488.1, AF081487.1, AFI65138.1,
AF064254.1, AP112117.1, U96409.1, AC005900.1, AC004636.1, AC004472.1, U69258.1, AL163224.2, AL163206.2,

TABLE 1-continued

Sequence homologies (GenBank Accession Numbers)

AL161537.2, X15901.1, Y08502.1, Z68873.1, AL022727.1, AL022097.1, AL031073.1, AL035528.2, AP001679.1,
AP000957.2, AW489091.1, AI230094.1, AI956324.1, AI956249.1, AA591244.1, AI316935.1, AW069322.1, AA498893.1,
AW318627.1, AI506418.1, AA542289.1, AA840049.1, AA205624.1, AI314009.1, AA499765.1, AV320109.1, W74245.1,
AA726333.1, AA408320.1, AA247166.1, AW755799.1, AW755396.1, AW568012.1, AW5 67990.1, AW397511.1,
AW234798.1, AA162193.1, AW681906.1, AL045611.2, M851924.1, AL044212.1, AL043449.1, AA793473.1,
AA690112.1, AA675583.1, AA360776.1, AA183406.1, AA120371.1, AV131040.1, AV047607.2, AV047086.2,
AI046570.1, AA499782.1, AA498000.1, AA144603.1, AA139245.1, AA138950.1, AA110497.1, AA062258.1,
AA060083.1, I123069.1, H10565.1, R59827.1, R28864.1, AC020834.2, AC015501.3, AC021286.3, AC022550.1,
AC022089.4, AC010428.4, AC011403.2, AC025168.3, AC021755.4, AC016767.3, AL163541.6, AL353608.2,
AL135795.3, AL163545.4, AL160031.4, AC026084.2, AC026562.3, AC051613.3, AC008483.4, AC046137.3,
AC068226.1, AC016002.5, AC031979.1, AC015578.4, AC019235.2, AC019228.4, AC017102.5, AC008519.2,
AC016281.2, AL356272.1, AL139823.2, AL137142.8, AL353625.2, AL121956.4, AL138965.3, AL136456.3,
SEQ ID NO. 141
NGO-Br-43
MK466/T3 5'

AB023420.1, X67643.1, L12723.1, AF077354.1, NM_008300.1, D85904.1, X67641.1, X67642.1, X67640.1,
AC011013.17, U23921.1, NM_014278.1, AB023421.1, NM_011020.1, D49482.1, AB001926.1, AL078621.19,
AL096821.2, Y13478.1, AL121904.13, AJ251914.1, AC010352.4, AC007662.2, NM_013559.1, AE003537.1,
AC004492.1, AC009248.6, AC007388.3, AF064254.1, U96409.1, AC004636.1, AL121821.5, AL161537.2, Z48006.1,
Z68873.1, AL022097.1, AL035528.2, L40406.1, M26221.1, D67017.1, D67016.1, AW489091.1, AI230094.1,
AA591244.1, AA498893.1, W74245.1, AA542289.1, AI314009.1, AI956324.1, AA121736.1, AI956249.1, AI316935.1,
AA162193.1, N85657.1, AW069322.1, AI506418.1, AV226442.1, AI956648.1, AA499765.1, AA354293.1, AV320109.1,
AW318627.1, AA205624.1, AA063966.1, R56974.1, AV226379.1, AA247166.1, AA840049.1, AW385268.1,
AW385266.1, AA726333.1, AV340213.1, M870749.1, AV047607.2, AV047086.2, AI046570.1, AA747312.1, C39670.1,
AA499782.1, AA498000.1, AA144603.1, AA139245.1, AA138950.1, AA110497.1, AA062258.1, AA060083.1, I123069.1,
H10565.1, R59827.1, AC020834.2, AC015501.3, AC021286.3, AC025168.3, AC021755.4, AC016767.3, AL163541.6,
AL353608.2, AL135795.3, AL163545.4, AL160031.4, AC026084.2, AC026562.3, AC064862.2, AC016002.5,
AC019235.2, AC017102.5, AL353625.2, AL121956.4,
SEQ ID NO. 142
NGO-Br-43
MK691/T3 5'

AB023420.1, X67643.1, L12723.1, NM_008300.1, D85904.1, AF077354.1, X67642.1, NM_014278.1, AB023421.1,
NM_011020.1, U23921.1, D49482.1, AB001926.1, NM_006644.1, AF039675.1, AB003334.1, D86956.1,
AE003433.1, AC004674.1, AC008545.3, AC011751.2, AC009489.3, NM_013559.1, AC006502.2, AC003006.1,
AL132793.24, AL135879.1, AL121790.2, AL008713.1, L40406.1, Z47807.1, M38250.1, D67017.1, D67016.1,
AC010879.2, AC012082.6, AC020943.5, AC006200.2, AF248484.1, AC009311.2, AC004459.1, AC004745.1,
AC003984.1, AC002452.1, AC0024.61.1, AC004612.1, AC004741.1, AC004503.1, AC002519.1, AC008173.2,
AC005406.2, AC006559.6, AC003666.1, AF101874.2, AC003689.1, AC003678.1, AC005393.1, AC004075.1,
AC004043.1, U01882.1, U80460.1, AL160192.2, AL049555.6, AL035665.29, AL078595.12, U50871.1, AL050334.12,
AL096802.1,1, Z97987.1, Z92844.1, Z98748.1, Z84475.1, AL009176.1, U41995.1, AB005275.1, Y15994.1, AB016880.1,
AB020870.1, AA354293.1, AL135032.1, AA162193.1, W74245.1, AA821679.1, AA103602.1,
AA874242.1, AA518224.1, AI907727.1, AA121221.1, AW861596.1, N85657.1, AA542289.1, AW582514.1, AW372094.1,
AW817315.1, AW371571.1, R56974.1, AW817219.1, AW817496.1, AW817372.1, AW817364.1, AW817164.1,
AW817153.1, AW609859.1, AW609846.1, AW609816.1, AW609809.1, AW609769.1, AW582510.1, AW582499.1,
AW391901.1, AW381775.1, AW371552.1, AW371546.1, AA437859.1, AW069842.1, AW379104.1, AW477440.1,
AW817432.1, AW817319.1, AW609867.1, AW609856.1, AW391888.1, AW384296.1, AW371549.1, AW371548.1,
AW817445.1, AW817442.1, AW609844.1, AW371570.1, AW817504.1, AW371556.1, AW817234.1, AW371553.1,
AW817318.1, AA870633.1, AA125191.1, AW609784.1, AW582504.1, AW372095.1, AA191559.1, W20649.1,
AW601252.1, AA896038.1, AI314009.1, AA543642.1, AW372116.1, AA498893.1, AV226442.1, AW578931.1,
AV226379.1, AW578926.1, AA063966.1, AA385978.1, AJ396671.1, AW371561.1, AI827505.1, D29434.1, AW748834.1,
AA591244.1, AW371568.1, W26511.1, AW229772.1, H93522.1, AV226463.1, AA549649.1, AW577563.1, AL042714.2,
AI656127.1, AI633338.1, AI267631.1, AI203278.1, AA714219.1, AA580845.1, AA311379.1, AW210124.1, X85639.1,
AC020834.2, AC021286.3, AL137142.8, AC013883.1, AL133489.1, AL121814.1, AC069108.1, AC068732.1,
AC021076.3, AC067810.1, AC010814.5, AC023692.2, AC000875.2, AP001587.1, AP001180.1, AC034305.2,
AC068992.3, AC040960.2, AC026998.2, AC044809.2, AC023410.3, AC025752.4, AC022433.3, AC022430.3,
AC022135.3, AC008961.4, AC008968.4, AC011346.3, AC008561.3, AC008539.3, AC021595.3, AC017100.3,
AC010133.2, AC010810.3, AC009657.3, AC026824.2, AC027281.2, AC021548.3, AC011954.5, AC023858.2,
AC015681.4, AC025411.2, AC021948.3, AC013321.4, AC025218.2, AC013368.4, AC011055.6, AC017082.3,
AC015943.3, AC021208.3, AC015823.3, AC016421.4, AC013297.4, AC022039.2, AC023560.2, AC023034.2,
AC025599.1, AC012451.3, AC021350.2, AC021319.1, AC007799.4, AC013759.2, AC011107.2, AC007914.1,
AL355345.2, AL160407.4, AL157785.2, AL139344.4, AL355599.2, AL355332.1, AL353143.2, AL161913.2, AL353624.1,
AL158819.2, AL133255.9, AI157759.2, AL158140.2, AL034378.2, AP001488.1, AP001336.1,
SEQ ID NO. 143
NGO-Br-44
MK062/T3 5'

AF210818.1, AF134894.1, AB014540.1, NM_009302.1, AF053974.1, AE003678.1, AE003692.1, AC004260.1,
AC005244.1, AL162633.2, AL138996.2, AL049522.1, AL035603.11, AE003589.1, AE002906.1, AC006926.1,
AC002080.1, U91322.1, AC006043.1, AC005082.2, AF128252.1, AF128251.1, AF128249.1, AF128247.1, AC005548.1,
AC005269.1, U32723.1, AL022598.2, AL133391.5, AL121656.2, Z35601.1, AL034561.4, AL033530.1, U35657.1,
K01711.1, AB027827.1, AB027454.1, M20865.1, J04355.1, Z66517.1, AI181303.1, AW824953.1, AW123265.1,
AW504308.1, AW824368.1, AW425515.1, AJ392422.1, AW202793.1, AW029904.1, AW487421.1, AV070180.1,
AU013359.1, AC025788.2, AC026250.3, AC011979.3, AC026628.2, AC009800.6, AC023126.2, AC014216.1,
AC009539.5, AL160255.5, AL138790.2, AC055752.5, AC055875.2, AC053484.3, AC021515.3, AC024494.1,
AC021857.2, AC010097.4, AC016475.1, AC012199.4, AC013013.1, AL031726.16, AL133259.23, AL355073.1,

TABLE 1-continued

Sequence homologies (GenBank Accession Numbers)

AU53152.2, AL137183.1, AP001852.1, AC024905.7, AC024890.7, AC008713.5, AC011376.2, AC008856.4,
AC026958.2, AC024595.2, AC026259.3, AC025966.2, AC025818.2, AC022735.3, AC024387.2, AC022040.2,
AC023375.2, AC017402.1, AC009610.1, AL356358.1, AL355293.2, AL008872.1,
SEQ ID NO. 144
NGO-Br-44
MK062/T7 3'

AB014540.1, AF134894.1, AC004834.2, AC006538.1, Z97054.1, AF111168.2, AL109914.16, AL121586.28, AC002094.1,
AC006457.3, AL031985.10, AC002400.1, U80017.1, AF030453.1, AL031846.2, Z95152.1, AC005031.1, AL049874.3,
Z72006.1, AC007386.3, AC000353.27, AC005207.1, AC003002.1, AL160191.2, AL034429.1, AC004552.1, AC004195.1,
AL078639.5, AF168787.1, AC002477.1, AC005796.1, AC005500.2, AP000689.1, AC005051.2, AC002492.1,
AC004815.2, AC005049.2, AC006064.9, AC005839.1, AC002350.1, AL163292.2, AP001747.1, AC005412.5,
AC003104.1, AL049569.13, AP000505.1, AP000045.1, AC011890.4, AC007225.2, AC005102.1, AL136295.2, Z85994.1,
AL050321.8, AC005227.2, AC003663.1, AC008115.3, AC011311.11, AC005793.1, AL024507.7, AL096800.20,
AL049795.20, AW467233.1, AA186857.1, AW572140.1, AW473996.1, AW327624.1, AI889579.1, AI049630.1,
H68343.1, AW850230.1, AI733856.1, AA135761.1, AA583386.1, AW873261.1, AW833047.1, AI754421.1, AA838091.1,
AA468923.1, AA176605.1, AW157005.1, AI452836.1, AI090377.1, AA152253.1, AI474127.1, AI192465.1, AI064786.1,
AA721645.1, AI799569.1, AI283938.1, H47736.1, AW798093.1, AI340151.1, AA992126.1, AI762528.1, AI309943.1,
AW769687.1, AW089625.1, AW008184.1, AA857812.1, AW167202.1, AA630854.1, AA298365.1, AI310343.1,
AW589345.1, AI859906.1, AI249365.1, AA302978.1, AW674631.1, AW516080.1, AW243808.1, AW069227.1,
M634187.1, AI457313.1, AI431513.1, AW242031.1, AW328331.1, AL038936.1, AI446336.1, AA827383.1, AA502991.1,
AA487569.1, AA130647.1, AW574899.1, AI815210.1, AI696878.1, AA642809.1, AA176257.1, AI336771.1, AI285493.1,
AI797998.1, AI653515.1, AA612727.1, AA218631.1, AI791659.1, AI278972.1, H57439.1, AI065038.1, N38991.1,
AA601218.1, AI362442.1, AI066711.1, AA832175.1, AI653776.1, AA604149.1, AI446623.1, AA877992.1, AW082104.1,
AI962030.1, F29968.1, AI049845.1, AA287570.1, AA284247.1, AW852684.1, AA633981.1, AA443390.1, AI633294.1,
AA594220.1, AA429197.1, AA429020.1, AA290878.1, AA569648.1, AC026250.3, AL356218.1, AC018751.22,
AL159970.7, AC027272.2, AC008630.3, AL136222.3, AC008616.3, AC019157.4, AL161671.5, AC012306.3,
AC023232.3, AC015795.3, AL135839.3, AC019268.3, AL355001.3, AC011771.3, AC013355.3, AC012652.3,
AL158828.4, AC044797.2, AL158039.2, AF235092.1, AC024561.3, AC008379.5, AC009149.4, AL354720.3,
AC027472.2, AL137849.2, AC009041.5, AC011423.1, AL355076.1, AC020922.5, AC011895.3, AC026051.3,
AL161911.3, AC021016.3, AC025395.2, AC008026.2, AC008745.4, AC015920.4, AL138762.5, AP001462.1,
AC011488.5, AC018557.4,
SEQ ID NO. 145
NGO-Br-45
MK506/T3 5'

AC005080.2, AC004883.2, AF015553.1, AF038969.1, AF038968.1, AF038967.1, AF035737.1, AF036613.1,
NM_010365.1, AF017085.1, AC002448.1, AC004637.1, AF133093.1, AC007681.3, AC007138.1, AL161493.2,
AL009179.1, AW513878.1, AW440589.1, AW303749.1, AW172719.1, AW150741.1, AI942459.1, AI926534.1,
AI890828.1, AI799542.1, AI755197.1, AI669472.1, M569466.1, M422057.1, AJ366702.1, AI359749.1, AI359734.1,
AI342520.1, AI341684.1, AI339415.1, AI334035.1, AI301890.1, AI268293.1, AI189650.1, AI016018.1, AI890844.1,
AW503621.1, AW131511.1, AI862016.1, AI832845.1, AI564518.1, AI361033.1, AI356100.1, AW117790.1, AI961455.1,
AI708465.1, AI359726.1, AI934639.1, W44732.1, AW157829.1, AA075629.1, AW504960.1, AI829529.1, AA527778.1,
AW069097.1, AI653807.1, AW150934.1, AI338067.1, AA412018.1, N26570.1, AI762723.1, AA843358.1, AI633291.1,
AA639747.1, AI523792.1, AA758117.1, AA156353.1, N26116.1, AA811496.1, W80780.1, AI613456.1, AI559431.1,
AW189020.1, AI305239.1, AI762958.1, N51844.1, N31942.1, AI491778.1, AA113854.1, AI270445.1, AA662713.1,
AA732559.1, AI290117.1, AA641906.1, AA632756.1, AI829267.1, AA535035.1, AA612924.1, AI880822.1, N90508.1,
AI924215.1, AI689619.1, AA441894.1, AW090502.1, AA581632.1, N58502.1, AI735656.1, AW129208.1, AI750591.1,
F21287.1, AA722095.1, AI538729.1, T03439.1, AI040879.1, H68263.1, AI699888.1, AI653613.1, AA720545.1,
AW503247.1, AI630929.1, AI582862.1, AC004166.10, AC061712.2, AC006995.2, AC005098.1, AC068263.1,
AC027219.1, AC018360.8, AC068475.1, AC013548.2, AC012587.4, AC018360.7, AC046131.3, AC023050.12,
AC020741.3, AC026529.2, AC021802.3, AC025847.2, AC026086.2, AC026241.1, AC007400.2, AC009235.2,
AL353134.2, AL162251.3, AP001983.1, AP000710.1, AP000643.1,
SEQ ID NO. 146
NGO-Br-46
MK283/T3 5'

NM_016374.1, AB030181.1, AF245512.1, AF208045.1, AF214114.1, AF227899.1, NM_002892.1, AL031777.2,
S66427.1, AB033596.1, NC_001136.2, AE003511.1, AC009322.1, AC007229.1, U80436.1, L77119.1, AC004440.1,
AL121985.13, AB026643.1, J03902.1, AC007188.6, AC002461.1, AP000457.3, AB005240.1, AA485189.1, R20183.1,
AW431383.1, F06553.1, AW431576.1, AI153796.1, AV249408.1, AV079586.1, AV295325.1, AV296868.1, AV304343.1,
AV335031.1, AV251198.1, AA713956.1, AV323916.1, AV351047.1, R14337.1, AW242991.1, AA296993.1, AV318231.1,
AV298138.1, AW820697.1, AV407971.1, AV407307.1, AW611599.1, AW571035.1, AW570959.1, AW570812.1,
AW163609.1, AW162962.1, AI506067.1, T86264.1, AW775546.1, AV439780.1, AW696915.1, AW693997.1,
AW690655.1, AW589802.1, AW470688.1, AW255547.1, AW243044.1, AW195535.1, AW135177.1, AI912938.1,
AI823378.1, AI816820.1, AI809563.1, AI803416.1, AV146241.1, AI770033.1, AI766212.1, AI766190.1, AI632787.1,
AI478418.1, AI280988.1, AI246187.1, AI242863.1, AI160538.1, AI143611.1, AI091619.1, AI055903.1, AI034050.1,
AI032880.1, AI015051.1, AA988532.1, AA922855.1, AA863243.1, AA811866.1, AA731602.1, AA524142.1,
AA375259.1, AA001674.1, W80645.1, W56179.1, W39715.1, W32984.1, W31210.1, R40471.1, AA524073.1,
AL353899.3, AL133418.3, AL161423.4, AC010092.3, AL136366.4, AL049185.4, AC021804.3, AC005140.6,
AC004153.5, AC022648.1, AC017725.1, AF181450.1, AC006858.1, AL157786.2, AC064811.2, AC027723.2,
AF254982.1, AC025820.3, AC027691.1, AC018982.1, AL354653.2, AL049180.3,

TABLE 1-continued

Sequence homologies (GenBank Accession Numbers)

SEQ ID NO. 147
NGO-Br-46
MK283/T7 3'

AF083249.1, AL133010.1, AF227899.1, AF214114.1, AF208045.1, NM_016374.1, AB030181.1, AF245512.1,
AE003519.1, U14635.1, NC_0011471 NM_012269.1, AC002454.1, AC012463.3, AC006029.2, AE001314.1,
AF009010.1, AF039906.1, AL163262.2, Z97055.1, AL031429.11, AL096773.6, Z75151.1, AP001717.1, AP000189.1,
AP000045.1, AP000300.1, AP000113.1, AI091806.1, AW450239.1, AI632699.1, AI130893.1, AI017851.1, AA279595.1,
AA082926.1, AI474175.1, AA169631.1, AI136605.1, AW534954.1, AW047204.1, AA669471.1, AW050083.1,
AA249450.1, AI138109.1, AI138113.1, AA248905.1, AW641956.1, AW402551.1, AU079907.1, AI817621.1,
AV071325.1, AI472756.1, AA586216.1, AA347968.1, AA273379.1, H84029.1, H57875.1, R90945.1, H17170.1,
AL133418.3, AL353899.3, AC015441.1, AC067880.1, AC007990.2,
SEQ ID NO. 148
NGO-Br-46
MK482/T3 5'

NM_016374.1, AB030181.1, AF227899.1, AF208045.1, AP214114.1, AF245512.1, AF053249.1, AC027657.1557j62j
S57160.1, S57153.1, AC006420.3, U23522.2 NM_002892.1, AC007032.2, AC004440.1, 566427.1, Z48784.1,
AC002461.1, AC005207.1, AC004048.1, AL031595.4, AP001819.1, AA485189.1, R20183.1, AL079586.1, AW431383.1,
F06553.1, AW431576.1, AW242991.1, AA296993.1, AI153796.1, AV249408.1, AV295325.1, AV296868.1, AV304343.1,
AV335031.1, AV251198.1, AV323916.1, AA713956.1, AV351047.1, AV318231.1, AA743290.1, AW496257.1,
AV298138.1, AW820697.1, AW611599.1, AW571035.1, AW570959.1, AW570812.1, AV162962.1, H34667.1, T86264.1,
AW754057.1, AV439780.1, AW696915.1, AW693997.1, AW690655.1, AW341096.1, AW270194.1, AW207299.1,
AV318321.1, AW057255.1, AW043594.1, AV146241.1, AI698675.1, AI698047.1, AI570113.1, AI506941.1, AI393132.1,
M361113.1, AI246187.1, AI222232.1, AA962426.1, AA926638.1, AA837710.1, AA829497.1, C68432.1, C57364.1,
AA370189.1, C10349.1, W88641.1, N73528.1, H69420.1, H50563.1, H24328.1, H24314.1, H23256.1, F02811.1,
C11969.1, AL133418.3, AL353899.3, AC011267.2, AL136366.4, AC020604.4, AC068607.1, AC008570.3, AC021804.3,
AC022944.2, AC022648.1, AC017725.1, AL121987.2, AC064811.2, AC021183.2, AC027723.2, AC026384.2,
AF254982.1, AC027412.2, AC009881.3, AC013653.2, AC018982.1, AL034557.7, AL049180.3,
SEQ ID NO. 149
NGO-Br-46
MK482/T7 3'

NM_016374.1, AB030181.1, AF208045.1, AF227899.1, AF214114.1, AF083249.1, A.p245512.1, Nc 001137.2,
U18916.2, AC007032.2, L77119.1, AC005687.1, AP001073.1, AP000969.1, AC002038.1, AC007882.3, AC007188.6,
AC009230.3, AC007379.2, AE003827.1, AE003758.1, AE003644.1, AE003410.1, AC002041.1 AC004161.1,
AC018359.6, AC004827.1, AC004890.2, AC004896.1, AC009322.1, AC006352.3, AC006359.3, AC004671.1, U40947.1,
AC005207.1, U00176.1, U67526.1, AL355921.1, AF004387.1, AL080287.1, AL050333.18, AL117353.6, AL034563.1,
AL132769.1, U66528.1, Y00354.1, U33010.1, U33008.1, M18061.1, AP000391.1, AP000543.1, J05080.1, AL079586.1,
AW242991.1, AA296993.1, AA743290.1, AA485189.1, AW496257.1, R20183.1, AI153796.1, AV318231.1, T61718.1,
F06553.1, AV295325.1, AV249408.1, AV304343.1, AV296868.1, AV251198.1, AV335031.1, AV323916.1, AW431383.1,
AW875017.1, AW875016.1, AW571035.1, AW570959.1, AW570812.1, T86264.1, AW696915.1, AW693997.1,
AW690655.1, AW773470.1, AV439780.1, AW472410.1, AV351047.1, AW056097.1, AW021051.1, AI963428.1,
AI741526.1, C93293.1, AA668233.1, C23844.1, W36281.1, T14884.1, AL133418.3, AC010092.3, AC019046.3,
AC007990.2, AC023145.4, AC016789.4, AC011267.2, AL136366.4, AC017057.5, AC068607.1, AC008570.3,
AC0684.44.1, AC068256.1, AC067904.1, AC021804.3, AC023200.2, AC0I6697.2, AP000742.1, AC019071.3,
AC064811.2, AC068761.2, AC026273.5, AC021183.2, AC068541.2, AC026740.3, AC008480.3, AC027723.2,
AF254982.1, AC010791.2, AC026897.2, AC016108.3, AC025610.2, AC024972.2, AC019110.3, AC024025.3,
AC024315.2, AC007908.2, AC023202.2, AC023576.1, AC009209.5, AC010683.3, AC011231.3, AC009981.5,
AC021671.1, AC009982.6, AC017924.1, AC014837.1, AL356288.1, AL034557.7, AP001017.2, AP001007.1,
AP001109.1,
SEQ ID NO. 150
NGO-Br-46
MK712/T3 5'

NM_016374.1, AB030181.1, AF245512.1, AF178849.1, Y17968.1, AC004537.1, AI118523.15, AIC000096.1
AL021396.5, AL118494.1, S51239.1, AB032988.1, NM_008671.1, NM_008665.1, NM_001978.1, AF004294.1, U28389.1,
U28734.1, X92352.1, L19713.1, AC002039.1, AF222800.1, 579939.1, D86076.1, Z46939.1, D83650.1, D31729.1,
NM_008253.1, NM_003449.1, AC004186.1, U59897.1, AF022465.1, U09825.1, U17837.1, AC007844.32, NM_005381.1,
AF132047.1, AC006289.1, AE001393.1, AC004659.1, AF030001.1, AL035527.1, X86100.1, U15800.1, AB010266.1,
L04162.1, AK001314.1, AK000250.1, AK000221.1, AB015639.1, AB020693.1, AP000344.1, L08135.1, L22219.1,
NM_003204.1, AC007870.3, D37887.1, X84060.1, L14750.1, L24123.1, X77366.1, U08853.1, NM_010238.1,
AF069772.1, AC006925.6, AF045462.1, AF017349.1, AL121754.18, AL132977.1, AL009226.1, U14731.1, D89801.1,
AB011480.1, D84418.1, NM_015866.1, NM_0149771 NM_012749.1, AF124726.1, AF133520.1, AF19611.1,
U17838.1, AL163217.2, U89340.1, U19361.1, AP001672.1, U12825.1, D45132.1, AB014570.1, AC018721.1,
NM_008252.1, AC002302.1, AF085279.1, AC006070.1, U46900.1, Z83117.1, Z46757.1, M15825.1, AW431576.1,
AA485189.1, AW431383.1, W84569.1, W67770.1, AA262427.1, R20183.1, AW369401.1, F06553.1, AI036486.1,
AV340693.1, AV249408.1, AV295325.1, AI153796.1, AV296868.1, AV304343.1, AV335031.1, AA713956.1,
AV251198.1, R14337.1, AV323916.1, AV351047.1, AI102488.1, AJ397247.1, AW158536.1, AA960471.1, AL079721.1,
AU060883.1, F08518.1, M79841.1, AW281090.1, AI573315.1, AV407435.1, AW561908.1, AW099610.1, AI931397.1,
AI505223.1, AI159593.1, AA939911.1, AA838901.1, AA413260.1, D22328.1 AI044390.1, AW366844.1, AI908284.1,
H33616.1, R54825.1, AW531362.1, AW162962.1, M746770.1, AI579779.1, AI579345.1, AI575698.1, AI558058.1,
M408526.1, AI408307.1, AW681502.1, AW398648.1, AU061751.1, AU060420.1, AU053145.1, AU053100.1,
AA685125.1, AW682367.1, AW681399.1, AW681336.1, AW619893.1, AW553956.1, AW553928.1, AW550476.1,
AW549664.1, AW548257.1, AW547813.1, AW546306.1, AW545571.1, AW545015.1, AW543191.1, AW542602.1,
AW541865.1, AW536650.1, AW536323.1, AW320463.1, AW320328.1, AV111141.1, AV071436.1, AI376890.1,
AI183692.1, AI182809.1, AU015986.1, C85885.1, C85603.1, AA795177.1, AA636994.1, C80539.1, AA607084.1,

TABLE 1-continued

Sequence homologies (GenBank Accession Numbers)

AA606813.1, AA590440.1, AA420329.1, T52646.1, AL353899.3, AC040981.1, AC012588.5, AC023288.6, AC018745.2,
AC068493.3, AC053536.2, AC025669.2, AC026017.2, AC026462.1, AC006279.6, AC007340.3, AC024173.1,
AC020757.2, AC016876.1, AC005136.1, AL163051.1, AC026581.1, AC024111.6, AC002317.1, AL136382.3,
AL136998.12, AL355576.1, AL355366.1, AL158172.1, AC026532.2, AC034245.2, AC016569.3, AC068147.1,
AC027275.1, AC021768.3, AC016171.4, AL121953.13, AL049796.27, AL133375.3, AP000448.1, AC068909.3,
AC012055.6, AC034126.2, AC044806.1, AC019128.3, AC020879.2, AC017104.3, AC021627.2, AC020632.4,
AC041041.2, AC021142.4, AC026163.2, AC015535.4, AC016989.4, AC020988.3, AC024625.1, AC015901.3,
AL356459.1, AL157895.1, AP001488.1, AP001024.1, AC016142.6, AC020940.4, AC019028.3, AC009717.4,
AC023364.3, AC013334.6, AC022565.3, AC020509.1, AC017725.1, AC004123.1, AC005861.2, AL354874.1,
AL034557.7, AC009361.17, AC015891.10, AC063968.1, AC027650.2, AC025364.2, AC012296.3, AC022310.2,
AC023571.2, AC023284.1, AC009962.3, AC021444.1, AL035477.5,
SEQ ID NO. 151
NGO-Br-47
MK265/T3 5'

NM_004987.1, U09284.1, AK000906.1, AE003678.1, AF078907.1, AF035583.1, U41021.1, AE003528.1, NM_0008881
AL137129.2, AL050403.13, Z69648.1, M35198.1, AC007380.3, AE003454.1, NM_008407.1, AC004300.1, AE000795.1,
Z71186.1, X70393.1, Z99123.1, Z80360.1, X95584.1, AW504514.1, AI327306.1, AA299595.1, AA289280.1, AI862555.1,
AI609736.1, AA968535.1, AI608376.1, AA037783.1, AI948956.1, AI956192.1, AA201027.1, AI152133.1, AI195455.1,
AI089674.1, AA198689.1, AA732465.1, AA766629.1, AA989985.1, H58225.1, AA970328.1, AW787078.1, AW787072.1,
AI450546.1, AA799637.1, AW742584.1, AA510363.1, AA450826.1, AA504265.1, AA110054.1, AI854549.1, AI195654.1,
AI986356.1, AI943339.1, AW142146.1, AA102210.1, AI593658.1, Z42656.1, AI722835.1, AI353353.1, H58562.1,
AW493431.1, AI237400.1, AA848258.1, AA636357.1, AA220130.1, AW347458.1, AI464258.1, AI408319.1,
AW481822.1, AW417049.1, AW312785.1, AW140389.1, AA119018.1, R58438.1, AI398975.1, AW017114.1,
AI386040.1, AA066359.1, AI981121.1, AI262403.1, AA646588.1, AA358612.1, AJ392355.1, AA064613.1, AI986343.1,
AA511616.1, AW140647.1, AI929976.1, AV203690.1, AV198544.1, AV194653.1, AV194457.1, AV187669.1, C48705.1,
C48492.1, C48145.1, C45906.1, C41445.1, AA471768.1, D76144.1, AW216171.1, AA269965.1, AA069994.1,
AA016593.1, I73549.1, AC010095.3, AC011919.3, AC013271.1, AC011922.2, AC010976.4, AC027815.1, AC012487.3,
AC014215.1, AC016057.3, AC016797.3, AC022102.3, AC016575.6, AC021017.3, AC020993.3, AC013658.3,
AC024522.1, AC010066.5, AC014423.1, AL136985.1, AC026261.3, AC027627.3, AC008864.4, AC008740.3,
AC037456.4, AC025781.5, AC025706.3, AC024453.2, AC018914.3, AC021788.2, AC023463.2, AC019902.1,
AL022281.20, Z98874.1,
SEQ ID NO. 152
NGO-Br-48
MK124/T3 5'

AI251245.1, AC0048902 NM_009477.1, D44464.1, AC007371.16, AL034423.18, AL096761.1, AE003806.1,
AF022713.2, AP133262.1, AP133263.1, U69607.1, AC004287.1, U65480.1, AF007190.1, AL035420.15, AW630547.1,
AI769091.1, T58810.1, AA403044.1, AW436458.1, AI713670.1, AI712879.1, AI060054.1, AI412971.1, AI010977.1,
AW318411.1, AW012719.1, AA817712.1, AA943539.1, AA404342.1, AW121356.1, AI837465.1, AI823387.1,
AI877170.1, AL118479.1, AI325217.1, AA023318.1, AA020155.1, W34889.1, AI099015.1, W08125.1, R51103.1,
AW820705.1, AA475225.1, AA411125.1, AA171085.1, AL160054.4, AC021561.3, AP001490.1, AC027461.1,
AC027462.2, AC023571.2, AL355353.3, AC018714.3, AC016883.3, AC022244.2, AC027559.1, AC018671.5,
AC016402.1, AL353782.3, AU61937.5, AL022335.6, AP001000.1, AC021874.12, AC021023.4, AC018352.8,
AC018656.5, AC012674.7, AC022504.9, AC055882.3, AC018752.3, AC010396.3, AC008596.3, AC013747.5,
AC068557.1, AC034137.2, AC024948.2, AC007944.2, AC022830.2, AC024504.2, AC011635.3, AC012378.5,
AC021874.11, AC016346.2, AC021250.2, AC018352.7, AC020957.1, AC017056.3, AC020077.1, AC016510.1,
AC012123.1, AL356217.2, AL122125.1, AL031301.1, AP001888.1, AP001123.1, AP000550.1,
SEQ ID NO. 153
NGO-Br-48
MK124/T7 3'

AJ251245.1, NM_006703.1, AF062530.1, AF062529.1, AL117352.12, AJ249395.1, Z98036.1, AC010305.3, AC006474.3,
AC002098.1, AC000396.1, AL078603.4, Z66560.2, M20162.1, AE003687.1, AE003539.1, AE003452.1, AC005005.1,
AC004466.1, AC005268.1, AF015725.1, AL163300.2, AU 63268.2, Z73972.1, Z99714.2, Z83001.1, Z97200.1,
AJ011930.1, AP001068.1, AB012242.1, AB008267.1, AJ229042.1, Z48305.1, X14710.1, AI270576.1, AA349855.1,
H60027.1, AA639612.1, R25924.1, AW392280.1, AW450452.1, M014725.1, AA092495.1, W58640.1, AW022648.1,
AI179962.1, AW431718.1, N55875.1, AI178673.1, AW427283.1, R14767.1, AI179961.1, AW868962.1, D21042.1,
AW062717.1, AW062693.1, AI654799.1, AI652271.1, AI493530.1, AI435022.1, AI289025.1, AI126256.1, AI086076.1,
AI032793.1, AA838460.1, AA781029.1, AA643067.1, AA629918.1, AA594551.1, AA573873.1, AA505932.1,
AA479474.1, AA447455.1, AA446652.1, AA256802.1, AA150300.1, AA148791.1, AA086458.1, AA030012.1, W05069.1,
N51389.1, R34884.1, AI158210.1, AW785190.1, AV305650.1, AU080152.1, AI987624.1, AI810108.1, AI764741.1,
AI607860.1, AI546326.1, AI388669.1, AU033961.1, AI144326.1, AI113962.1, AI020516.1, AA951467.1, AA736165.1,
AA701889.1, AA700625.1, AA504833.1, AA404221.1, AA404687.1, AA159318.1, H84256.1, H34335.1, H05385.1,
AC021561.3, AP001490.1, AC025405.2, AC011945.3, AL354740.4, AL137801.1, AC068548.2, AC027395.2,
AC018358.6, AC068739.2, AC026022.2, AC021088.2, AC068386.1, AC020552.3, AC018966.3, AC007721.15,
AC016427.3, AC015622.3, AC009703.2, AC005910.4, AC002320.1, AL161452.3, AP001257.1, AL022276.1,
AC009522.3, AC063940.4, AC025005.2, AC016572.4, AC005513.6, AC027074.2, AC012184.3, AC016883.3,
AC011794.4, AC009871.5, AC010966.2, AC015676.3, AC024237.3, AC018232.1, AC018272.1, AF165146.1,
AC006171.1, AC004847.1, AL356461.1, AL159154.3, AL162399.3, AL133410.10, AL162589.1, AL136001.1,
AP001078.1, AP000899.2, AP001029.2, AP001113.1, AL008875.1,
SEQ ID NO. 154
NGO-Br-49
MK4111/T3 5'
NM_004349.1, 578158.1, D14821.1, D43638.1, D14289.1, D13979.1, X79990.1, NM_009822.1, X79989.1, D32007.1,
S78159.1, D14823.1, AF018276.1, AF018275.1, AF018283.1, D14822.1, AF018274.1, NM_009824.1, AF038029.1,
AB010420.1, AB010419.1, AF018277.1, AB013280.1, AF052215.1, S74096.1, NM_005187.2, AF069747.1,

TABLE 1-continued

Sequence homologies (GenBank Accession Numbers)

NM_005093.1, AF068266.1, AF052210.1, AF013970.1, AF039200.1, AF212198.1, AF076455.1, AL034421.4,
AC007842.1, AF022978.1, AB037757.1, AC023838.1, AC004011.1, AC006208.3, AE001039.1, AC002297.1,
AC001229.1, AL133445.2, AL049766.14, AL096843.1,1, AL008634.1, Z84466.1, AL022721.1, AI005682.1, U01337.1,
AJ005077.1, L24038.1, AP000385.1, X77694.1, H18342.1, AW659083.1, AL134801.1, H18378.1, R91340.1,
AW409814.1, AA597034.1, AW411004.1, AI880924.1, AW047315.1, AW526016.1, AW319793.1, AW319604.1,
AW125686.1, AW060692.1, AV127503.1, AI6065041, AA996736.1, AI407074.1, AI176767.1, AI171652.1, AI152215.1,
AI046358.1, AA914494.1, AA822901.1, AA674424.1, AA529559.1, AA261311.1, AA222118.1, AA222011.1,
AA963424.1, W39519.1, N75171.1, R70443.1, AV170567.1, AA924939.1, AI169429.1, W89980.1, AA015563.1,
AC015952.3, AC013551.1, AF181450.1, AC068674.1, AC011671.3, AC009149.4, AC021125.2, AL121906.12,
AC031998.2, AC013552.4, AL158160.1, AC012485.4, AC009989.6, AC006431.8, AC021193.3, AC022029.3,
AC009438.2, AC027023.2, AC019055.3, AC007779.2, AC015667.3, AC027146.1, AC021291.3, AC023300.3,
AC023545.2, AC015598.3, AC023438.2, AC020713.2, AC016279.2, AC007936.1, AL109823.21, AL160211.1,
AL135961.1, AP001892.1, AP001637.1, AP000798.1, AP000662.1,
SEQ ID NO. 155
NGO-Br-49
MK4111/T73'

NM_004349.1, D14821.1, D43638.1, D14289.1, D13979.1, X79990.1, 578158.1, NM_009822.1, D32007.1, X79989.1,
AF018282.1, AC007161.1, AC003006.1, AE000663.1, AC011494.2 AC012147.7, AC004846.2, AC005058.1,
AC007630.3, AF109907.1, M13209.1, AL034365.1, Z70782.1, AL031176.7, S55844.1, X67119.1, X16144.1, X01978.1,
K03329.1, J02070.1, K01729.1, M17293.1, AJ224792.1, AJ224790.1, D49508.1, AI420591.1, AI033811.1, H94855.1,
AW411005.1, AI167424.1, AW409570.1, AI264845.1, AA904353.1, F02579.1, N75054.1, AU041415.1, AW192965.1,
AA992855.1, R38996.1, AV162276.1, N86959.1, AA247686.1, AV240937.1, AI078840.1, AV245662.1, P01701.1,
AI080687.1, AV347330.1, N88058.1, AA463390.1, AA095305.1, AI825475.1, H46432.1, AW450741.1, AW063104.1,
AI723657.1, AI604144.1, AI574526.1, AA257797.1, AW859690.1, AW177930.1, AW849569.1, AW849241.1,
AW575067.1, AW257554.1, AV332137.1, AV153186.1, AI476165.1, AI445297.1, AI445224.1, AI181996.1, AI116642.1,
AA469797.1, AA469776.1, AA194741.1, AA125063.1, AC015952.3, AF181450.1, AC068674.1, AC010295.4,
AC017222.1, AC008197.2, AL136968.4, AL096708.33,
SEQ ID NO. 156
NGO-Br-49
MK571/T3 5'

NM_004349.1, S78158.1, D14821.1, D43638.1, D14289.1, D13979.1, X79990.1, NM_009822.1, X79989.1, D32007.1,
S78159.1, D14823.1, AF018276.1, AF018283.1, AF018275.1, S74096.1, D14822.1, AF018274.1, NM_009824.1,
AF038029.1, AF018277.1, AB010420.1, AB010419.1, AB013280.1, AF052215.1, NM_005187.2, AF018278.1,
AF069747.1, NM_005093.1, AF068266.1, AF052210.1, AF013970.1, AF039200.1, AF212198.1, AF076455.1,
AL034421.4, AC010285.4, AC007842.1, AF022978.1, AB037757.1, AC023838.1, AC004011.1, U91322.1, AC006208.3,
AE001039.1, AC001229.1, AL133445.2, AL049766.14, AL096843.11, AL031682.1, AL008634.1, Z84466.1, AL022721.1,
AJ005682.1, U01337.1, AJ005077.1, L24038.1, AP000385.1, X77694.1, H18342.1, AI005077.1, AI033811.1, H18378.1,
R91340.1, AW409814.1, AA597034.1, AW411004.1, M880924.1, AW047315.1, AW526016.1, AW319793.1,
AW319604.1, AW125686.1, AW060692.1, AV127503.1, AI606504.1, AA996736.1, AI407074.1, AI176767.1,
AI171652.1, AI152215.1, AI046358.1, AA914494.1, AA822901.1, AA674424.1, AA529559.1, AA261311.1, AA222118.1,
AA222011.1, AA963424.1, W39519.1, N75171.1, R70443.1, AW433933.1, AV170567.1, AI555661.1, AA924939.1,
AI169429.1, AA196015.1, AA120052.1, W89980.1, AA015563.1, AC015952.3, AC013551.1, AF181450.1, AC068674.1,
AC011671.3, AC009149.4, AC021125.2, AL121906.12, AC031998.2, AC013552.4, AL158160.1, AC025418.5,
AC010313.4, AC016533.5, AC023924.2, AC011094.2, AC027737.2, AC050049.1, AC038905.1, AC013648.3,
AC012485.4, AC009989.6, AC012154.9, AC006431.8, AC021193.3, AC012626.4, AC009078.4, AC022029.3,
AC009438.2, AC027023.2, AC019055.3, AC007779.2, AC026911.2, AC026958.2, AC015667.3, AC027146.1,
AC021291.3, AC023300.3, AC023545.2, AC015598.3, AC006404.20, AC023438.2, AC020713.2, AC016279.2,
AC009878.3, AC007936.1, AL160211.1, AL135961.1, AP001892.1, AP000798.1, AP000662.1,
SEQ ID NO. 157
NGO-Br-49
MK571/T7 3'

NM_004349.1, D14821.1, D43638.1, Dl4289.1, D13979.1, X79990.1, S78158.1, NM_009822.1, D32007.1, X79989.1,
AF018282.1, AE003739.1, AC007161.1, AC003006.1, AE000663.1, AC012147.7, AC004846.2, AC005058.1,
AC007630.3, AL031176.7, S55844.1, X67119.1, X01978.1, AI420591.1, AI033811.1, H94855.1, AW411005.1,
AI167424.1, AW409570.1, AI264845.1, AA904353.1, F02579.1, N75054.1, AU041415.1, AW192965.1, AA992855.1,
R38996.1, AV162276.1, N86959.1, AA247686.1, AV240937.1, AI078840.1, AV245662.1, F01701.1, AI080687.1,
AV347330.1, AA463390.1, N88058.1, AI825475.1, AA095305.1, H46432.1, AW450741.1, AW063104.1, AI885714.1,
AI723657.1, AI604144.1, AI574526.1, AA257797.1, AW859690.1, AW575067.1, AW257554.1, AV332137.1,
AV153186.1, AI476165.1, AI445297.1, AI445224.1, AI181996.1, AI116642.1, AA469797.1, AA469776.1, AA194741.1,
AA125063.1, AC015952.3, AF181450.1, AC068674.1, AC017222.1, AC008197.2, AL096708.33, AC011005.4,
AC024483.2, AC012431.5,
SEQ ID NO. 158
NGO-Br-50
MK253/T3 5'

NM_013235.1, AP116910.1, AK001121.1, AE003484.1, AL135784.4, L33180.1, L22858.1, Z83744.1, L35905.1,
X71415.1, AF178030.1, Z95126.1, Z98266.1, AB025632.1, X78287.1, AC008969.5, AC027659.1, AC024799.1,
AC013453.1, AC007038.3, AC007591.2, AC005284.1, Y14344.1, AA543176.1, AW237908.1, AA153374.1, AA144562.1,
AA114761.1, AA046045.1, AW834734.1, H34369.1, AA549506.1, AA623764.1, AA797275.1, AW246359.1,
AW702080.1, AA083888.1, AA199399.1, AA461807.1, AW860954.1, AI681138.1, C72137.1, AW836479.1,
AW416148.1, AV141668.1, AI678836.1, AI035692.1, C84814.1, AA768917.1, AA722287.1, R66162.1, R59232.1,
AC008768.4, AC008159.1, AC026712.3, AC008419.0, AC010348.3, AC008550.3, AC018857.3, AC013905.1,
AC008035.8, AC046148.2, AC010243.3, AC016555.4, AC026300.2, AC012586.6, AC015725.3, AC009591.3,
AC010897.3, AC016998.1, AC012338.2, AL136987.2, AC021874.12, AC021023.4, AC018916.6, AC012041.8,

TABLE 1-continued

Sequence homologies (GenBank Accession Numbers)

AC011312.5, AC055789.2, AC067752.2, AC026780.2, AC010457.5, AF260012.1, AC026167.2, AC011050.4,
AC011148.4, AC016099.3, AC026205.3, AC023780.2, AC023571.2, AC024598.2, AC020755.2, AC021874.11,
AC020856.1, AC024159.1, AC006595.1, AC006788.1, AL355353.3, AL139143.4, AL138885.4, AL355482.1,
AL354864.1, AL161639.4, AL160008.1, AP001280.1, AP001085.2, AP000577.1,
SEQ ID NO. 159
NGO-Br-50
MK253/T7 3'

NM_013235.1, AF116910.1, AK001121.1, AC006349.3, AL023807.6, AC008082.12, AC008160.11, AF060568.1,
AF016679.1, U51999.1, X52871.1, M15387.1, AE003826.1, AC007056.4, AF088189.1, AC006216.1, AF099810.1,
AC002397.1, AE000092.1, AL163221.2, U96131.1, AL117672.3, AL049758.11, AL035427.17, AL022578.1, AP001676.1,
D87952.1, AP000403.1, AW246572.1, AA827562.1, AA514488.1, AI190270.1, AL135673.1, AI539185.1, AA778031.1,
AA083889.1, AW874309.1, AA255533.1, AW662264.1, AI539830.1, AA532881.1, F19104.2, AA459956.1, AW701839.1,
AA749416.1, AI972095.1, AI874853.1, AW656237.1, AW793352.1, AW793354.1, AI247961.1, AW246359.1,
AW793373.1, AU042596.1, N66268.1, AA271691.1, AI630888.1, AW522844.1, AA255505.1, AI502808.1, AA384265.1,
AW438881.1, AA729375.1, AA364111.1, AW363733.1, AW638275.1, AA538198.1, AV084911.1, AA702934.1,
AI940043.1, AW428205.1, AV008608.1, AW702080.1, AL134250.1, AI159057.1, AA711797.1, AA120508.1, T06791.1,
AV319126.1, AA739069.1, AV319605.1, AV038838.1, U94841.1, AA461807.1, AW803473.1, AI937621.1 AI673094.1,
AI105163.1, AA638281.1, AA559086.1, AA473595.1, AA331632.1, H87048.1, AC026712.3, AC008768.4, AC008159.1,
AC068577.1, AC020880.2, AC021229.2, AC012557.7, AC021482.4, AC022782.2, AC024656.2, AC020742.2,
AC019262.3, AL354712.2, AL354656.1, AP000908.1, AC024898.7, AC009716.3, AC065132.2, AC020930.4,
AC010393.4, AC010266.7, AC010500.4, AC034195.2, A0023478.2, AC024928.4, AC049149.1, AC021380.3,
AC023761.2, AC016498.4, AC026219.1, AC026198.1, AC026188.1, AC02,5978.1, AC005653.8, AC017064.4,
AC011981.3, AC022668.3, AC022335.6, AC022002.2, AC022989.2, AC021141.2, AC016397.4, AC009673.2,
AC013573.2, AC017933.1, AC008031.3, AC010167.1, AF165425.1, AC007715.1, AL096868.7, AL353585.3,
AL160403.3, AL160281.3, Z82199.1, AL132638.1, AP001445.1, AP001194.1, AP001130.1,
SEQ ID NO. 160
NGO-Br-50
MK496/T3 5'

NM_013235.1, AF116910.1, AK001121.1, AE003484.1, I23180.1, L22858.1, Z83744.1, I25905.1, X71415.1, Z98266.1,
AC008969.5, AE003629.1, AC000370.1, AC013453.1, AC007591.2, AE001718.1, AC004673.1, AC005751.1,
AC002995.1, AL031670.6, Z81133.1, AL035467.23, AA460045.1, AA153374.1, AA144562.1, AW246359.1,
AA549506.1, AW834734.1, AA623764.1, AA083888.1, AA114761.1, AL134250.1, AA543176.1, AW702080.1,
AA797275.1, AA199399.1, AW428205.1, AA461807.1, AA711797.1, AW237908.1, AA538198.1, AA120508.1,
AI987530.1, AI681138.1, C72137.1, AW836479.1, AW559878.1, AW416148.1, AU039592.1, R66162.1, R59232.1,
AC026712.3, AC008768.4, AC008159.1, AC046148.2, AC013905.1, AC010190.7, AC063946.3, AC025265.5,
AC010243.3, AC016555.4, AC026300.2, AC015725.3, AC010897.3, AL136987.2, AC021874.12, AC021023.4,
AC011312.5, AC012114.2, AC067752.2, AC010457.5, AC010381.4, AC025546.3, AC009135.6, AC068121.1,
AC067828.1, AC025700.3, AC018508.4, AC025039.3, AC022526.4, AC016099.3, AC021736.3, AC010785.3,
AC021242.3, AC023860.2, AC024598.2, AC021874.11, AC020856.1, AF230637.1, AC016906.3, AC015747.1,
AC020115.1, AC007300.5, AC004387.1, AL353194.6, AL138885.4, AL355482.1, AL354933.1, AP001869.1,
SEQ ID NO. 161
NGO-Br-51
MK071/T3 5'

NM_003137.1, U09564.1, NM_016795.1, AB012290.1, AJ224115.1, Z99128.1, NM_009274.1, U92456.1, AB006036.1,
NM_003138.1, U88666.1, AF043288.1, AC005070.1, AE003811.1, AF133093.1, AF043289.1, ABO17067.1, AC023279.2,
AC005220.1, AL160231.2, AL023634.1, AB023037.1, D13447.1, AE003484.1, AF002725.1, AE000541.1, AE001458.1,
AF052290.1, AL021127.2, AL021180.1, AL022311.5, AB035133.1, AB006605.1, AW611721.1, AA060080.1,
AA492926.1, AL048784.3, AW006865.1, AU051027.1, AL046120.2, AA382461.1, AW500688.1, AW637436.1,
AW701629.1, AJ396085.1, AA864027.1, AA211241.1, AI605657.1, AW635365.1, AW422773.1, AW421817.1,
AW128008.1, AI722256.1, AW629710.1, AW381192.1, AW153931.1, AI626169.1, N28924.1, AI595541.1, AI038250.1,
AI854277.1, AI787785.1, AI599584.1, W92175.1, AA428487.1, N23469.1, AW701402.1, AW462697.1, AI848239.1,
AI414590.1, AI184192.1, AA553654.1, AW149364.1, AW016345.1, AI869878.1, AI830963.1, AI808855.1, AI808450.1,
AI555245.1, AI248681.1, AI247996.1, AI200995.1, AI199780.1, AI127471.1, AI075315.1, AI032748.1, AI018413.1,
AI018139.1, AI000892.1, AA573426.1, AA479899.1, W92176.1, N35218.1, H98745.1, AA537749.1, AI296396.1,
W12836.1, AW668908.1, AW392218.1, AI510017.1, AA968079.1, AA062255.1, AW736509.1, AW705048.1,
AW704786.1, AW277878.1, AW277356.1, AW277342.1, AV375020.1, AV293419.1, AV287373.1, AV284759.1,
AV234361.1, AW099987.1, AW036092.1, AI960739.1, AV174923.1, AI794688.1, AV118805.1, AI703778.1, AI507200.1,
AA972378.1, AA891069.1, AA863700.1, AA086829.1, AL133507.3, AC022452.2, AC017471.1, AC022525.3,
AC023305.2, AC022106.2, AC011540.2, AC010787.3, AC021963.3, AC023913.4, AC016956.6, AC060815.2,
AC068798.4, AC024102.5, AC023158.4, A0020570.3, AC023052.13, AC025765.3, AC025178.3, AC022444.3,
AC022423.3, AC008411.3, AC008803.3, AC023779.2, AC024479.3, AC037484.1, AC016985.4, AC019298.3,
AC027165.1, AC009072.2, AC016956.5, AC013441.2, AC013907.1, AC005108.1, AL160162.4, AL133356.3,
AL157696.2, AL009027.1,
SEQ ID NO. 162
NGO-Br-51
MK071/T7 3'

Z99128.1, NM_003137.1, U09564.1, NM_016795.1, AB012290.1, AJ224115.1, A3005937.1, AE003588.1, AC004116.1,
AL031534.1, AL137450.1, AL023534.1, AW594310.1, AW082913.1, AI672149.1, AI126291.1, AW338805.1,
AA490202.1, AA629288.1, AW848261.1, AA921804.1, R78142.1, AI076709.1, AW510886.1, AW275479.1,
AW376532.1, T77446.1, AA284106.1, R29335.1, AA323127.1, R78141.1, W25929.1, AW123035.1, AI648020.1,
AA899108.1, AU024203.1, AU020306.1, N76402.1, N77083.1, AA383402.1, AW674276.1, AW275654.1, AW103361.1,
AW091907.1, AW039956.1, AW008221.1, AI799557.1, AI598063.1, AI458262.1, AA915976.1, AA373583.1,
AA059466.1, W73010.1, N36259.1, N24536.1, H26379.1, AW727130.1, AW702067.1, AW489711.1, AW421443.1,

TABLE 1-continued

Sequence homologies (GenBank Accession Numbers)

AW144384.1, AV167622.1, AV060461.1, AI697622.1, AI630968.1, AI325483.1, AI235699.1, AI210173.1, AI152339.1,
AI034064.1, AI006140.1, AA798365.1, AA764641.1, AA450512.1, AA408261.1, AA122933.1, AA097370.1,
AA024303.1, W36820.1, W11581.1, W08677.1, D19317.1, D24037.1, AL157823.3, AP001449.1, AL139347.2,
AC026566.1, AC018197.1, AC024107.9, AC021650.9, AC008810.4, AC026466.3, AC026959.2, AC023271.3,
AC024193.2, AC009792.4, AC020730.2, AC021155.2, AF178220.1, AP000794.1,
SEQ ID NO. 163
NGO-Br-52
MK111/T3 5'

NM_003373.2, NM_014000.1, M33308.1, NM_009502.1, L18880.1, J04126.1, Y00312.1, L13300.1, S52276.1, S52271.1,
AF067624.1, AL163852.1, AL138646.2, AC007138.1, AF047564.1, U82828.1, AL161552.2, AL161493.Z AL161492.2,
U55724.1, Z98946.15, AL080253.2, X52256.1, AC007347.3, AC002485.1, AF107675.1, AC005026.1, AC008170.2,
AC007560.3, AF147259.1, AC004063.1, AL163290.2, AL132793.24, AL161506.2, AL049871.3, AP001745.1,
AP001619.1, AP001800.1, X91233.1, AB033053.1, AL048129.1, AA853564.1, AA375439.1, AV441119.1, AA585825.1,
AW202184.1, AW577790.1, AW498327.1, AV404553.1, AV402299.1, AU004063.1, AU004045.1, AU003308.1,
AI042965.1, AJ003662.1, AC025425.4, AC021191.3, AC006874.1, AC025212.2, AC011797.4, AC025104.2, AC015687.3,
AL354652.3, AP001925.1, AP001808.1, AP000838.1, AC024933.7, AC023598.10, AC022072.8, AC051642.2,
AC015891.10, AC068973.1, AC055869.2, AC068886.1, AC025477.3, AC0I8753.3, AC008859.4, AC026557.2,
AC068246.1, AC022993.3, AC012211.3, AC046149.2, AC012068.3, AC026824.2, AC026087.3, AC034111.1,
AC025061.2, AC020672.3, AC012252.4, AC026566.1, AC018911.4, AC015938.3, AC018973.3, AC022041.2,
AC023916.2, AC011298.2, AC021950.1, AF216674.1, AC013695.1, AF191252.1, AL118506.16, AL161442.7,
AL139157.4, AL138744.7, AL136980.3, AL354744.1, AL354696.1, AL137022.7, AP001954.1,
SEQ ID NO. 164
NGO-Br-52
MK111/T7 3'

NM_003373.2, NM_014000.1, M33308.1, AL121751.12, AC007237.3, AC005405.1, Z50070.2, AC006332.3,
NM_005509.1, AE003635.1, AC006979.2, AF204929.1, AF185647.1, U80443.2, AC000104.1, AL138478.2,
AL078605.30, A3005821.1, D90900.1, AB017062.1, AL043388.1, AL048130.1, AW613219.1, AL042874.1, AL047646.1,
AI564569.1, AW338462.1, AI871828.1, AW341948.1, AI744828.1, AI754173.1, AI889651.1, C06476.1, AI564600.1,
AW189900.1, AI583605.1, AW31664.6,1, AA776250.1, AW268882.1, AI833189.1, AA564112.1,
AA486728.1, AA458903.1, AW067932.1, AW026609.1, AA284505.1, AI808349.1, AI041865.1, AA744683.1,
AA744677.1, N35013.1, AI367320.1, AW070464.1, AA723251.1, AA478033.1, AI161355.1, AA521095.1, AI956152.1,
AI753120.1, AA653613.1, AI890467.1, AA173528.1, AA160880.1, AA653144.1, W72421.1, AA031689.1, AI095313.1,
AI243169.1, AA744691.1, N27658.1, AA909152.1, AI381956.1, AA548423.1, AI240491.1, AA705238.1, AA150688.1,
W76280.1, I124935.1, AI290052.1, M953995.1, AA099284.1, AI003089.1, AI041158.1, AA299485.1, I147593.1,
R87481.1, H06272.1, AA670014.1, AI750559.1, AW081510.1, H62215.1, T92938.1, F32136.1, W15223.1, H28559.1,
AA045285.1, I157205.1, AW438657.1, AA490932.1, R78919.1, AA165451.1, AI206471.1, AA370855.1, AI952389.1,
AA853565.1, AW118302.1, AW193451.1, T92716.1, H51597.1, AA831147.1, I138452.1, AA776247.1, T23463.1,
T93331.1, AI694888.1, H97605.1, T92712.1, AA904909.1, R62767.1, AC025425.4, AL110115.28, AL138753.3,
AL139114.3, AC015970.4, AC010278.5, AC008883.3, AC008446.3, AC012583.3, AC021516.4, AC011944.3,
AC024317.2, AL139042.3, AL162411.1, AC023673.1, Z81488.1, AC041006.2, AC036146.2, AC068429.1, AC068020.1,
AC026458.3, AC024492.2, AC015873.2, AC022770.4, AC010579.8, AC025134.1, AC023828.1, AC011066.4,
AC011750.3, AC019782.1, AC013663.1, AC010213.2, AC009339.1, AL096888.26, AL161671.5, AL161653.7,
AL160172.4, AL109824.23, AL135901.4, AL162759.1, AL136301.4, AL136985.1, AL137785.2, AP000863.1,
AP000784.1,
SEQ ID NO. 165
NGO-Br-53
MK282/T3 5'

X98494.1, AL133363.1, AE002611.1, Z83848.1, AF036707.1, AP118145.1, AC002060.3, AF022981.2, AF125969.1,
D87023.1, AC008757.5, AE003498.1, U76408.1, AC009303.2, AF197947.1, AF242181.1, AE003844.1, AE003477.1,
NM_011241.1, AF098623.1, AF098622.1, AF098621.1, AF098620.1, AF098619.1, AF098618.1, AF098617.1, U48809.1,
AF046092.1, AF046084.1, U53154.1, AF057293.1, AE000661.1, U20857.1, Y14591.1, AJ242625.1, Y18000.1, Y14592.1,
D87010.1, AC010252.3, AC008174.2, AF216973.1, AF220200.1, AF030052.1, Z73905.1, U10577.1, U67889.1,
AL031652.1, AK001686.1, AP000501.1, AB011164.1, AA848124.1, AW365568.1, T24602.1, AW365559.1, AA603307.1,
AI844833.1, W33952.1, W75630.1, W64795.1, AV113531.1, AV113797.1, AV114982.1, AI709759.1, AW365540.1,
AI137651.1, AI070777.1, AW376006.1, AI546038.1, C94041.1, AV294399.1, AI959638.1, AI793667.1, AI406906.1,
L37652.1, AV427570.1, AV409781.1, AW638224.1, AW560695.1, AW517166.1, AI398790.1, AW345759.1,
AW187449.2, AV314465.1, AV312363.1, AW128487.1, AI994267.1, AV024242.1, AV020965.1, AI641607.1,
AA388279.1, R9024.6,1, T75711.1, AV420624.1, AW703701.1, AW604496.1, AW579832.1, AW443988.1, AW373650.1,
AW361293.1, AW361221.1, AL038706.1, C99888.1, AI384793.1, AA147878.1, W26394.1, T92366.1, T90227.1,
AC007881.3, AC007345.2, AC007342.2, AC009673.2, AC016033.2, AC025138.2, AC018348.1, AC023310.1,
AC027794.1, AC026150.1, AC036148.2, AC022113.4, AC020980.3, AC016621.4, AC027472.2, AC018409.3,
AC018491.7, AC014030.1, AC011402.5, AC026275.3, AC009792.4, AF178220.1, AC006844.1, AC027245.1,
AC013451.7, AC012931.1, AC009682.3, AC023659.2, AC025303.1, AL355178.2, AC034214.3, AC027621.3,
AC064793.1, AC025856.2, AC015454.3, AC022783.2, AC018510.3, AC015672.3, AC014497.1, AL353612.5,
AL163151.1,
SEQ ID NO. 166
NGO-Br-53
MK282/T7 3'

X98494.1, AF135002.1, AI760199.1, AI742680.1, AW384883.1, AI284853.1, AI222419.1, AA992199.1, AW044708.1,
AI862023.1 AI681988.1, AI867639.1, AI955575.1, AA992130.1, AI087795.1, AI263606.1, AA025657.1, AA083314.1,
AI094541.1, AA847842.1, AA731098.1, AA047545.1, AI420376.1, W80758.1, AA770202.1, AI357730.1, AW592097.1,
AA909134.1, AW369791.1, M271912.1, AA810790.1, N68965.1, AI806559.1, T97061.1, AI056034.1, AW591044.1,
AA668325.1, AA504113.1, AA347116.1, AW606827.1, AW608731.1, AI244315.1, AA837327.1, Z25156.1, AI809694.1,

TABLE 1-continued

Sequence homologies (GenBank Accession Numbers)

AA888598.1, H88801.1, F00393.1, AW130117.1, AI884600.1, AI679865.1, AI679289.1, AI386428.1, AI000365.1,
AA162148.1, AW556570.1, AA213194.1, H89025.1, AI177638.1, T96950.1, AA881872.1, AV146345.1, AA916136.1,
AW539498.1, AV077858.1, AI647220.1, AI326008.1, AA590060.1, C02251.1, AI406906.1, AW632569.1, AW532104.1,
AA817668.1, AV218492.1, AA619205.1, AC007881.3, A0021225.3, AC027794.1,
SEQ ID NO. 167
NGO-Br-54
MK123/T3 5'

AK001917.1, AF035606.1, NM_013232.1, U58773.1, NM_0110511 U49112.1, AC008925.3, AC007790.1, AC004485.1,
AC004025.1, AC004923.2, AC008078.11, AC002288.1, AE001146.1, AC000385.1, U73627.1, AC000389.1,
AL078590.27, AL049839.3, Z73424.1, Z95397.2, U40412.1, X14938.1, U03396.1, AB020682.1, AB020863.1, D89223.1,
AC010083.5, AF203377.1, AE003750.1, AE003637.1, AE003550.1, AC007514.5, AC010198.8, AC012039.10,
AC004893.1, AC004128.1, AF090189.1, AC006207.5, AC005007.1, A0005891.1, AC002366.1, AL031664.1,
AL161587.2, AL161577.2, AL133453.2, U22376.1, Z46267.1, Z97055.1, AL049649.4, AL049713.19, AL035246.13,
AL031177.1, AL023805.1, AL021879.3, AL031599.1, AL022198.1, AL109787.1, AL022604.1, U49956.1, AB012766.1,
AB022220.1, I20858.1, AW439592.1, AW058001.1, AI982775.1, AI912340.1, AA825538.1, AW513884.1, AW074361.1,
AI872206.1, AI798286.1, AI522238.1, AI758821.1, AW474823.1, AI572080.1, AA831357.1, AW337178.1, AI690445.1,
AI360561.1, AA775261.1, AI140796.1, AA835492.1, AI361820.1, AW004890.1, AA100279.1, M277190.1, AW517943.1,
AI917776.1, AI469550.1, AI015234.1, AA581345.1, AI689240.1, AI744762.1, AW769512.1, D20022.1, AA122332.1,
AI511224.1, AI355770.1, AW265061.1, AA485257.1, AA092467.1, AI471817.1, AI702026.1, T34498.1, AI597962.1,
AW545016.1, AW544484.1, AI852320.1, AI839826.1, AV173766.1, AI646046.1, AI415428.1, AA959713.1, AA855573.1,
AA116476.1, C85464.1, AW545749.1, AV269112.1, AV262681.1, AI884872.1, AV169832.1, AV064737.1, AV012020.1,
AU019447.1, AV299656.1, AV154525.1, AV335637.1, AV301925.1, AI835781.1, AV160371.1, AV139152.1,
AV138338.1, AV065117.1, AV051902.1, AV245530.1, AV338545.1, AV273829.1, AV214086.1, AV251164.1,
AV249977.1, AV234666.1, AV163377.1, AV167956.1, AV136391.1, AV064067.1, AV062993.1, AV061701.1,
AV057279.1, AV028650.1, AV232758.1, AV064377.1, AV063220.1, AV062771.1, AV059304.1, AV244517.1,
AV215643.1, AV301794.1, AI706252.1, AV254397.1, AA956495.1, AI180308.1, AW465410.1, AC061974.2,
AC060789.2, AC019267.3, AC026124.3, AC021067.5, AC025543.2, AC018428.3, AC024418.2, AC021067.4,
AL163533.5, AL355887.1, AC068587.1, AC032016.2, AC009664.4, AC027523.2, AC026135.2, AC025830.2,
AC013389.3, AC015474.3, AC023518.3, AC011774.4, AC012552.2, AF231129.1, AC016460.1, AC013750.4,
AC015980.1, AL161658.3, AL050340.7, AL136373.2, AP001848.1, Z99293.1,
SEQ ID NO. 168
NGO-Br-54
MK123/T7 3'

AK001917.1, AF035606.1, NM_013232.1, U58773.1, NM_011051.1, U49112.1, AC008925.3, AC007790.1, AC004485.1,
AC004923.2, AC008078.11, AE001146.1, AC000385.1, U73627.1, AC000389.1, AL049839.3, Z95397.2, U03396.1,
D89223.1, AW439592.1, AW055001.1, AI982775.1, AI912340.1, AA825538.1, AW513884.1, AW074361.1, AI872206.1,
AI798286.1, AI522238.1, AI758821.1, AW474823.1, AW337178.1, AI690445.1, AI572080.1, AA831357.1, AI360561.1,
AA775261.1, AI140796.1, AW517943.1, AW004890.1, AI361820.1, AA835492.1, AI917776.1, AA100279.1, AI277190.1,
AI469550.1, AI015234.1, AI689240.1, AW769512.1, AA581345.1, AI744762.1, D20022.1, AA122332.1, AI511224.1,
AL355770.1, AI471817.1, AI702026.1, AW265061.1, AA485257.1, AI597962.1, AA092467.1, T34498.1, AI624976.1,
AI811439.1, AV262681.1, AV249977.1, AW545749.1, AW545016.1, AW544484.1, AV335637.1, AV303323.1,
AV299656.1, AV324700.1, AV273829.1, AV269112.1, AV251768.1, AV235453.1, AV232758.1, AV214086.1,
AI852320.1, AI839826.1, AI835781.1, AV173766.1, AV138338.1, AV070618.1, AV065117.1, AV064737.1, AV063220.1,
AV062993.1, AV062771.1, AV061701.1, AV057279.1, AV051902.1, AV028650.1, AV012020.1, AI646046.1,
AA959713.1, C85464.1, AA116476.1, AV303717.1, AV338545.1, AV301925.1, AV296289.1, AV259612.1, AV245530.1,
AV244517.1, AV234666.1, AV215643.1, AV210921.1, AV167956.1, AV154525.1, AV153177.1, AV152413.1,
AV136391.1, AV132769.1, AV064791.1, AV064377.1, AV064067.1, AV059304.1, AC061974.2, AC060789.2,
AC019267.3, AC027145.1, AL163533.5, AC011699.5, AC025164.7, AC026102.5, AC055810.2, AC068587.1,
AC034259.2, AC032016.2, AC025615.2, AC027523.2, AC026135.2, AC025965.2, AC025543.2, AC013389.3,
AC023518.3, AC018428.3, AC011774.4, AC011699.4, AF231129.1, AF228730.1, AC013750.4, AC007310.1,
AL096888.26, AL353663.2, AL050340.7, AP001848.1,
SEQ ID NO. 169
NGO-Br-56
MK271/T3 5'

U13369.1, X03205.1, M10098.1, K03432.1, X00686.1, X82564.1, M11188.1, X01117.1, V01270.1, X06778.1, K01593.1,
X00640.1, AF173638.1, AF173637.1, AF173636.1, AF173635.1, AF173634.1, AF173633.1, AF173632.1, AF173631.1,
AF173629.1, AF173628.1, AF173627.1, AF173625.1, AF173624.1, AF173623.1, AF173622.1, AF173621.1, AY173620.1,
AF173619.1, AF173618.1, AF173617.1, AF173616.1, AF173615.1, D84514.1, AF173630.1, AP173626.1, AF173613.1,
X04025.1, X59734.1, AF173612.1, AF173610.1, AF173609.1, AF173608.1, AF173607.1, AF173606.1, M97576.1,
X59733.1, M91180.1, AF173611.1, AP115860.1, X02995.1, J00999.1, K01373.1, AF173614.1, AF173605.1, AF169014.1,
X98843.1, M91182.1, M91179.1, M91183.1, M91181.1, X98841.1, X98846.1, L11288.1, X98844.1, AF102857.1,
A3270031.1, AJ279506.1, U87963.1, X98840.1, X98837.1 NM_007841.1, D50494.1, X98842.1, X98838.1, X98836.1,
AI277531.1, X98839.1, X98845.1, AF030250.1, M33066.1, AJ270032.1, I24123.1, M59402.1, M97575.1, M59384.1,
M97573.1, AF157625.1, M59401.1, M59393.1, M59392.1, AF021880.1, M59386.1, M59385.1, AF236803.1, AF236802.1,
AJ007613.1, M59396.1, M59390.1, AW794857.1, AW579814.1, AW580540.1, AW601150.1, AW601147.1, AW601146.1,
AW803842.1, AW773277.1, AW773263.1, AW579819.1, AW864483.1, AW801020.1, AW579820.1, AW802332.1,
AW795520.1, AA409121.1, AW869663.1, AW820465.1, AW860385.1, AW601994.1, AJ241168.1, AU080818.1,
AW866280.1, AW841972.1, AW802330.1, AW601111.1, AW866367.1, AW866279.1, AW804859.1, AW604972.1,
AW602533.1, AW866444.1, AW803373.1, AW206333.1, AA900286.1, AW804923.1, AW809369.1, AW801069.1,
AW607233.1, AW804888.1, AI058227.1, AW793732.1, AW750335.1, AW867019.1, AW868469.1, AW864482.1,
AW866513.1, AW803865.1, AW784679.1, AW803389.1, AW841701.1, AW580567.1, AW806873.1, AU023662.1,
AW802360.1, AW868472.1, AW841735.1, AW579825.1, AW862813.1, AW802322.1, AW581425.1, AW803866.1,
AW802405.1, AW864515.1, AW804909.1, AW802410.1, AW797997.1, AW601124.1, AW864460.1, AW577599.1,
AW804949.1, AW869661.1, AW363080.1, AW841738.1, AW804307.1, AW864524.1, AW804302.1, AW601130.1,

TABLE 1-continued

Sequence homologies (GenBank Accession Numbers)

AW601094.1, AW868926.1, AW602408.1, AW868199.1, AW773266.1, AW773181.1, AW773102.1, AW868212.1,
AW804283.1, AW868207.1, AW864334.1, AW804702.1, AW581420.1, AW803872.1, AW527555.1, AW864530.1,
AW864525.1, AW804289.1, AW773310.1, AW864624.1, AW864534.1, AW868455.1, AL353644.2, AL158197.6,
AC011630.2, AC023572.3, AC027604.2, AC068192.1, AC026915.1, AC064866.2, AL355134.1, AC069087.1,
AC025654.2, AC064825.3, AC025630.1, AC010970.2, AC010554.1, AC018688.4, AC025968.1, AC064844.1,
AC027174.1, AC068900.1, AC016828.4, AC006763.1, AL049183.5, AC019020.4, AC025330.2, AP000639.1,
AC012647.15, AC008031.3, AC005806.2, AC012386.9, AC060712.1, AC064263.1, AC067527.1, AC067410.1,
AC065739.1, AC065644.1, AC065474.1, AC064126.1, AC064016.1, AC063445.1, AC062950.1, AC062797.1,
AC062782.1, AC060627.1, AC060379.1, AC060840.1, AC059708.1, AC059318.1, AC059021.1, AC058845.1,
AC058431.1, AC057969.1, AC057826.1, AC056563.1, AC057287.1, AC057204.1, AC057180.1, AC056774.1,
AC051336.1, AC051335.1, AC050735.1, AC050283.1, AC050278.1, AC050261.1, AC048611.1, AC048549.1,
AC043304.1, AC043037.1, AC045314.1, AC044975.1, AC042630.1, AC042522.1, AC041360.1, AC041109.1,
AC039370.1, AC039308.1, AC039109.1, AC038920.1, AC038318.1, AC037587.1, AC036362.1, AC036088.1,
AC035291.1, AC034717.1, AC034385.1, AC034335.1, AC030306.1, AC030238.1, AC029865.1, AC029864.1,
AC029705.1, AC035311.1, AC034638.1, AC033832.1, AC029523.1, AC027847.1, AC056957.1, AL157407.2,
AC025184.3, AC011135.2,
SEQ ID NO. 170
NGO-Br-57
MK3710/T3 5'

AF025438.1, AL050353.1, AE003680.1, AC005539.1, AL024458.1, AC004680.2, AC004455.1, AC005966.1, U63928.1,
Y18930.1, Z48544.1, X79080.1, AW161135.1, W58718.1, N32746.1, AA313566.1, AA024784.1, AA236836.1,
AA007319.1, R72404.1, AA236656.1, AI090162.1, AI630438.1, AA701988.1, AA852227.1, AA137279.1, AA541923.1,
AA000683.1, AI337332.1, AW161742.1, AW427494.1, AI828070.1, AI935340.1, AI760923.1, AI765742.1, W10638.1,
AI630424.1, H30501.1, R17187.1, AI964006.1, AI304319.1, W43974.1, AI765022.1, AA236789.1, AW051324.1,
H25699.1, AW592648.1, N56244.1, AW485468.1, AA865602.1, AI631687.1, AA000401.1, AI765999.1, N66532.1,
AI888263.1, AW557853.1, H35482.1, AA003291.1, M076924.1, AI461713.1, AW466965.1, AA637410.1, AW805299.1,
AI808237.1, AW536613.1, AA687041.1, AA452088.1, AA916723.1, AI585560.1, AA024685.1, AW152251.1,
AI430072.1, AA007455.1, AA759800.1, AA546383.1, AW614505.1, AW772254.1, AA916358.1, AW272790.1,
AI336121.1, AA607321.1, AI599140.1, AA521369.1, AI167263.1, AI283104.1, AI140745.1, AA345744.1, AW645427.1,
AA995467.1, AA451907.1, N23163.1, AI753758.1, AI841918.1, R77800.1, AA505618.1, AA110039.1, AI685071.1,
AU024430.1, AA959647.1, AA913049.1, AW636012.1, AI538205.1, AA385531.1, AI073755.1, AW823008.1,
AU024429.1, AI352390.1, R72405.1, R41738.1, AU022981.1, AL119291.1, AI171338.1, AL136131.7, AL355349.1,
AL138706.1, AC032027.2, AP000831.1, AP000713.1, AC013237.1, AL160276.2, AC069160.1, AC011168.4,
AC046152.2, AC017106.3, AC023448.2, AC012335.2, AC006279.6, AC013779.3, AC007345.2, AC007342.2,
AC015860.2, AC012273.1, AL353640.6, AL354937.2, AL159996.4, AL138815.4, AL157366.3, AL161780.3,
AL163973.1, AL136298.1,
SEQ ID NO. 171
NGO-Br-57
MK3710/T7 3'

AL050353.1, AF025438.1, AL121924.12, U42838.1, AL031055.1, AL121931.10, AL139076.2, AL024458.1, AC004680.2,
AC010889.2, NM_007050.2, AF043644.4, AE003844.1, AE003680.1, AE003533.1, AE003519.1,
AE003480.1, AE003422.1, AE003217.1, AE002799.1, AC004455.1, AC009320.7, AC007478.1, AC007123.1,
AC005548.1, AL163232.2, AC000389.1, AL035633.15, AL032654.1, Z68335.1, AL024473.1, Z92844.1, AL110503.1,
AP001687.1, AP001297.1, AP000459.3, AB005234.1, D17799.1, D17798.1, D17797.1, AB009052.1, AB006621.1,
AI964006.1, AI337332.1, AI765742.1, AA236789.1, AI304319.1, AA701988.1, AW592648.1, AI765022.1, AA865602.1,
AI828070.1, AI765999.1, AI760923.1 N66532.1, AI631687.1, AI935340.1, AA916723.1, AW161742.1, AA024685.1,
AW152251.1, AW772254.1, AA916358.1, AI336121.1, AW614505.1, AW051324.1, AI888263.1, N23163.1, AA007455.1,
AW272790.1, AI167263.1, AI283104.1, AA451907.1, AA995467.1, AI753758.1, AA505618.1, AI073755.1, AA913049.1,
AI538205.1, AA670386.1, AI352390.1, AA680352.1, AW151295.1, AA720562.1, AA723980.1, AI808237.1,
AW466965.1, AI081040.1, AA992256.1, AI267913.1, AA532854.1, R41738.1, AA928158.1, AW117185.1, AA016221.1,
AA345744.1, R72405.1, AI140745.1, AI084344.1, AI079153.1, AA852226.1, H89982.1, AI539552.1, AA385531.1,
AA236836.1, N50079.1, AI090162.1, AW557853.1, AA858049.1, AW536613.1, AI461713.1, AI599140.1, AI678339.1,
AW172462.1, AA637410.1, AI678340.1, R77800.1, AI198148.1, AA546383.1, AW433804.1, AI841918.1, AI585560.1,
AW823008.1, AA541923.1, AU024430.1, AA959647.1, AA924060.1, AU022981.1, H30501.1, AA024784.1, T26930.1,
AI630424.1, AA137279.1, AI630438.1, AW161135.1, W58718.1, AA607321.1, AU024429.1, AA963706.1, AA765777.1,
AI505865.1, AI963259.1, AL136131.7, AL355349.1, AL138706.1, AL050335.24, AC016073.2, AC023651.2, AL354992.1,
AC026285.4, AC055116.2, AC012133.3, AC006756.1, AC012031.7, AC007953.7, AC027502.3, AC008926.5,
AC009679.3, AP000841.1, AP000783.1, AC012151.5, AC022226.7, AC018728.2, AC068509.1, AC026961.2,
AC011036.3, AL136231.5, AL157824.2,
SEQ ID NO. 172
NGO-Br-58
MK436/T3 5'

AF118652.1, NM_006541.1, AJ010841.1, AF118649.1, AF118650.1, AF118651.1, AC021044.4, W73086.1, AA307154.1,
W58564.1, AA363862.1, AW327841.1, AI902183.1, T06444.1, AW014738.1, AI822071.1, AI813451.1, AA452335.1,
W15560.1, H78479.1, H59799.1, F11379.1, R63123.1, I13390.1, N24488.1, I13556.1, F07471.1, N76641.1, T36308.1,
H17884.1, AW743314.1, AL024195.1, AI892878.1, AI541284.1, AI121283.1, AA423088.1, AA124189.1, AA119742.1,
AA086801.1, W14808.1, AA222785.1, AA293188.1, AA985756.1, AA711181.1, AA218282.1, W33933.1, AI685717.1,
T10785.1, AA815685.1, AA273544.1, AA238334.1, AA157103.1, AI595622.1, AI316625.1, AI119458.1, AA879644.1,
AA879757.1, AA390040.1, AA220693.1, AA217769.1, AA106608.1, W90901.1, W85535.1, AA050409.1, AA000754.1,
W57189.1, W36243.1, AA120515.1, AI929984.1, AA623076.1, AA939357.1, AA914937.1, AA674174.1, W16243.1,
AA009010.1, AA536703.1, W01696.1, AL117714.1, AW652677.1, AA929573.1, AA667299.1, AA561056.1, AA177257.1,
AA172553.1, AId 17786.1, AA066010.1, W16154.1, AA048263.1, W76881.1, C83514.1, C82658.1, R84921.1,
AA198255.1, H96310.1, W23637.1, AA833367.1, AA822615.1, AA140412.1, AI561434.1, AA545088.1, AA049167.1,
AW672942.1, AA222090.1, AA212687.1, AA866363.1, AA867450.1, AL161648.5, AL139123.2, AL138831.2,

TABLE 1-continued

Sequence homologies (GenBank Accession Numbers)

AC050138.1, AL158828.4, AL353613.2,
SEQ ID NO. 173
NGO-Br-58
MK436/T7 3'

NM_006541.1, AJ010841.1, AC020610.6, AC005666.1, AC004381.1, AC005972.1, AC004099.1, AC005519.2,
AC005899.1, AL034343.17, AC008582.11, AC005516.1, A0004601.1, AL110120.11, AC015511.4, AC005726.1,
AL035420.15, Z99128.1, AL022159.1, U91323.1, AC005520.2, MO11930.1, AC002036.1, AC007676.19, AF205588.1,
AC004525.1, AC004961.2, AL117337.25, U07000.1, AL034427.1, AL020997.1, AC009946.2, AC004584.1, AC003043.1,
AC002070.1, AC004552.1, AC005232.1, AC002425.1, AC006312.8, AC004968.1, AC005480.3, AC004821.2, U72787.1,
AL355916.1, AL117375.12, Z83840.7, Z94801.1, AL008718.23, AC007240.2, AC004463.2, AC004771.1, AL160231.2,
AL121825.19, AL022322.1, AL022238.1, AL021391.2, AL031296.1, AL031681.13, AC005015.2, AC007435.12,
AL163262.2, AL121658.2, AL121655.1, Z84486.1, AP001717.1, AC010285.4, AC000003.1, AC004883.2, AC005288.1,
AL163265.2, AL133396.1, Z83819.1, AP001720.1, AC009516.19, Z82243.1, AC009145.4, AC002544.1, AC005562.1,
U52111.1, AC011449.6, AC022149.3, AC005907.1, AL133243.1, AL035699.4, AC006509.15, AC007055.3, AL049779.4,
AL035658.7, Z82245.1, AP000557.2, AL049759.10, AC006581.16, AL049712.12, AC005778.1, AC002558.1, Z85996.1,
AL024474.1, AL008716.1, AC005755.1, AC003002.1, AI074462.1, H99205.1, AI038375.1, AL119361.1, AA299728.1,
AA732982.1, AA602488.1, AI963281.1, AI345497.1, AI371278.1, AA570441.1, AA487512.1, AW149972.1, AI829381.1,
AL079763.1, AA614595.1, AA491864.1, AW768439.1, AL135639.1, AI963725.1, AI858632.1, F25696.1, AI610602.1,
AI370302.1, AI285709.1, AA618392.1, AA618346.1, AA602468.1, AA306530.1, H70245.1, H66503.1, AA708669.1,
AA620386.1, AA362670.1, M77904.1, AW877774.1, AW467676.1, AI469586.1, AI375374.1, AI052628.1, AA700279.1,
AA613177.1, AA528405.1, AA515254.1, AA504694.1, AA382130.1, AA347199.1, AA338281.1, AA174071.1,
AA167567.1, R86266.1, AL134669.1, AI745457.1, AI734060.1, AI734052.1, AI732085.1, AI370199.1, AI288162.1,
AA876148.1, AA846808.1, AA678733.1, AA631935.1, AA489797.1, AA226144.1, AA226095.1, AA225949.1,
AW500075.1, AW177901.1, AW177895.1, AW177822.1, AW177816.1, H41308.1, AI073735.1, AA601218.1,
AA482054.1, AII174701.1, AW074405.1, N38996.1, AI500315.1, H62161.1, AW847624.1, AI597931.3, AW084237.1,
AI791265.3, AI468269.1, AI382183.1, AA194502.1, C05882.1, AA001398.1, AA828783.1, AA688148.1, AA455088.1,
AA194944.1, AA487225.1, AI005219.1, H73907.1, AA280681.3, N55212.1, AI082472.1, AA578774.1, AL161648.5,
AL139123.2, AL109615.18, AC020603.3, AC068727.1, AC011355.3, AL109843.17, AP001885.1, AC068847.1,
AC068583.1, AC021991.3, AC011022.4, AC010481.4, AC009038.5, AL050329.11, AC046162.2, AL136458.2,
AL162733.2, AC008474.6, AL139815.3, AC005047.2, AC026495.1, AL353596.2, AP001809.1, AL135787.8,
AL157789.3, AC024096.7, AC026603.2, AC007217.2, AL109823.21, AL355837.1, AL353641.1, AP001447.1,
AC036206.2, AC008403.5, AC004873.1, AP001787.1, AC063950.3, AC018462.3, AL139384.3, AL139327.12,
AC068785.4, AC063962.3, AP000717.1, AC010277.3, AC008484.3, AC064860.2, AC025692.3, AC020781.4,
AC023183.2, Z93015.7, AL355392.2, AL354932.4, AL139324.5, AC025265.5, AC026115.10, AC008622.4, AC025778.2,
AC025277.2, AC011486.5, AC022307.7, AC012659.3, AC010260.3, AC008671.3, AC025142.2, AL133458.12,
AL161789.3, AC009027.4, AC023089.2, AL356009.2, AP003855.1, AC068077.1, AC022795.3, AC020754.2,
AL353794.1, AP001279.1, AC008121.13, AC023831.3, AC019255.2, AP000846.1, AL353691.2, AL155353.2,
AC022156.4, AC016701.2, AC016525.3, AL161756.1, AL139396.1, AC008158.3, AC068786.4, AC009021.3,
AC010503.5, AC008614.4, AC009120.5, AC027394.2, AL353622.3, AC064835.3, AC013445.4, AP001187.1,
AL354760.1, AC012635.1,
SEQ ID NO. 174
NGO-Br-59
MK337/T3 5'
X56687.1, M61725.1, NM_014233.1, X53461.1, X53390.1, L42571.1, M61726.1, NM_011551.1, X60831.1, L42570.1,
M61724.1, AC004596.1, U65487.1, AF241726.1, X59863.1, X57201.1, X57561.1, X65698.1, X65697.1, AF164119.1,
AF102773.1, AL078477.5, AC010083.5, AC018765.4, AF157625.1, AC006254.10, U78553.1, AC002986.1, AE000747.1,
AE000803.1, AL353815.2, AL163290.2, U49246.1, AL049659.2, AL163812.1, AL117200.2, Z83125.1, Y09788.2,
L20418.1, U41548.1, AP001745.1, AP001618.1, X73942.1, AB014538.1, AA683270.1, AI990923.1, AI652105.1,
W56216.1, AI424653.1, AI361257.1, AW373605.1, AI263742.1, W28568.1, AA134165.1, AW867502.1, AI407688.1,
AV098625.1, AW607456.1, M121071.1, AA322474.1, AA494480.1, AA254648.1, AW362484.1, AA306865.1,
AI947817.1, AV207877.1, AV140171.1, AV122483.1, AI594085.1, AI551499.1, AI463712.1, C85526.1, AA606502.1,
AV083972.1, AI267702.1, AV392783. 3, AV392203.1, AV392190.1, AV392165.1, AV387615.1, P15738.2, AI047080.1,
C65313.3, AA437706.1, AC011606.6, AC060757.2, AC021999.2, AC020754.2, AC011606.5, AC024234.4, AC024899.4,
AL158052.2, AC068918.2, AC026801.2, AC008795.5, AC008855.4, AC011145.3, AC023857.2, AC007555.1,
AL137780.2, AL138811.1, AC016955.9, AC0I2522.7, AC011318.8, AC024891.8, AC061979.2, AC025638.3,
AC037426.2, AC034103.4, AC062039.1, AC009237.2, AC023015.3, AC023582.2, AC040893.1, AC019008.4,
AC019250.3, AC015801.3, AC013713.4, AC024253.2, AC022302.3, AC025598.1, AC022609.2, AC019251.2,
AC024119.1, AC016490.2, AC012499.3, AC018665.2, AC012340.2, AC009408.2, AL049715.21, AL157875.4,
AL355535.1, AL355506.1, AL162582.2, AL162372.3, AL163615.2, AL136447.4, AP001769.1, AP000941.2, AP000869.1,
AP000846.1, AP000827.1,
SEQ ID NO. 175
NGO-Br-59
MK337/T7 3'

NM_014233.1, X53461.1, X53390.1, X56687.1, NM_031551.1, X60831.1, AC004596.1, U65487.1, L42571.1, L42570.1,
M61725.1, M61726.1, X56688.1, AP241726.1, AF170811.1, AC007372.4, AC004912.1, AC007013.1, AC005295.1,
AL132896.1, AL049837.4, AI009934.1, AC004983.2, NM_0147711 AC005782.1, AL121934.15, AB040880.1,
AK000425.1, AK000265.1, AP000696.1, AB014561.1, AW373933.1, AW373896.1, AA626575.1, AA374794.1,
AI915777.1, AI798277.1, AI521078.1, AI087037.1, AW249403.1, W31280.1, AA651656.1, R36455.1, AA919770.1,
AA664208.1, AA329246.1, R36454.1, AA134166.1, AA961221.1, AA914265.1, AA913482.1, D56068.1, D56028.1,
AI907998.1, AA623692.1, AA413864.1, AA308880.1, AI740529.1, AA637361.1, AW793731.1, AA889124.1,
AA377594.1, AI907995.1, AA377898.1, AA438075.1, AA211953.1, W83843.1, AI762169.1, AA611296.1, AW519549.1,
AW390831.3, AI893975.1, AA500491.1, AA492907.1, W80099.1, W77364.1, W33457.1, AI105117.1, AA518740.1,
AW814069.1, AW814073.1, AI154308. 3, AW438655.1, AW298403.1, AW243881.1, AW166393.1, AW001988.1,
AI989406.1, AI971828.1, AI831668.1, AI208785.1, AI077671.1, AI027548.1, AA890545.1, AA768775.1, AA5 77311.1,
AA056073.1, AA022622.1, AA021002.1, AA020748.1, AA039643.1, AA013126.1, H84980.1, H85537.1, AW819846.1,

TABLE 1-continued

Sequence homologies (GenBank Accession Numbers)

AW556048.1, AW433907.1, AI968114.1, AI678953.1, AI651215.1, AI202697.1, AA220802.1, AW196586.1,
AW175973.1, AI513981.1, AI348282.1, AI297541.1, AI257079.1, AI187754.1, AA973975.1, AA942224.1, AA816918.1,
AA478079.1, AA126812.1, H39237.1, AA183999.1, W79356.1, AC011606.6, AC060757.2, AC021999.2, AC020754.2,
AC013606.5, AC009237.2, AC017099.3, AP00 3769.1, AP000827.1, AL362372.3, AC024234.4, AC021987.2,
AP000668.1, AC026803.2, AC008749.4, AC026930.2, AC026285.4, AC018761.4, AC023154.4, AC0 32482.3,
AC013200.2, AL353609.2, AL139423.4, AL161662.1, AC010189.4, AC007834.20, AC053546.3, AC007339.3,
AC022197.3, AC015867.2, AC022783.2, AC000005.1, AC020968.1, AL355293.2,
SEQ ID NO. 176
NGO-Br-62
MK804/T3 5'

NM_005134.1, AF111106.1, AC007736.3, AC008168.3, NM_013658.1, AC005324.1, X85991.1, AC004539.1,
NM_009134.1, AC006287.1, AF075627.1, AL122020.3, U58743.1, Y09108.1, AC009486.3, AE003769.1, AC004888.1,
AC005013.1, AC007463.3, AC008067.3, AF189157.1, AE001980.1, AC009888.1, AC005549.1, AL008733.10, Z68760.2,
L46672.1, X94768.1, AP001278.1, AP000816.1, M24411.1, Z99105.1, AB006424.1, AW673704.1, AW371829.1,
AW382321.1, AW371827.1, MOB 1867.1, AW382320.1, AW371825.1, AI687366.1, AL120881.1, N41948.1, AW239384.1,
AI286014.1, N40656.1, AW382480.1, AA161066.1, AW367894.1, AA332078.1, AW382482.1, AW659290.1,
AW500241.1, AA611470.1, AW392387.1, AA906014.1, AW535590.1, AW534364.1, AW533907.1, AW534600.1,
AW535963.1, AI552086.1, AW535977.1, AW535929.1, AW535612.1, AW535599.1, AW535574.1, AW535542.1,
AW535538.1, AW535507.1, AW535217.1, AW534451.1, AW534434.1, AW534374.1, AW534356.1, AW534229.1,
AW534224.1, AW534199.1, AW534112.1, AW534076.1, AW534005.1, AW533992.1, AW533915.1, AW532274.1,
AW532226.1, AW532183.1, AW532169.1, AW531827.1, AW531069.1, AW530797.1, AW530120.1, AW530107.1,
AW529979.1, AW529973.1, AW254242.1, AW254201.1, AW251947.1, AW251307.1, AW251102.1, AI709485.1,
AI578408.1, AI555305.1, AI549564.1, AI549513.1, AI549263.1, AI549090.1, AI548886.1, AI548373.1, AI548339.1,
AI547780.1, AI547618.1, AI547615.1, AI535377.1, AI535100.1, AI535055.1, AI535053.1, AI511474.1, AI501242.1,
AA900666.1, AI137299.1, AI072600.1, AI072263.1, AI072230.1, AI071899.1, AI071691.1, AI071396.1, AI071193.1,
AI071165.1, AI070019.1, AI058437.1, AI045860.1, AI045612.1, AI044996.1, AC021927.3, AP001381.1, AC015956.3,
AC007140.1, AC026964.2, AC018989.3, AC024046.2, AC012596.3, AC009574.3, AC2021114.3, AC018940.4,
AC022971.2, AC011172.4, AC016068.2,
SEQ ID NO. 177
NGO-Br-62
MK804/T7 3'

AF100744.1, U79267.1, NM_005134.1, AP111106.1, AE003449.1, AL163301.2, NM_000236.1, AC016041.5, M29193.1,
AL035653.12, AL023807.6, Z84475.1, J03895.1, M35432.1, J03540.1, X07228.1, D83548.1, AC010102.3, AC006283.5,
AE003514.1, AE003440.1, AC005690.8, AC006465.2, AC008075.2, AF101438.1, AL163302.2, AL163254.2,
AL163233.2, AL136018.2, AL133097.1, AL109627.18, Z76735.1, AP001709.1, AP001688.1, U23442.1, AP000950.2,
AP000204.1, AP000244.1, AP000126.1, AI076775.1, AI215696.1, AI601253.1, AA581865.1, AI371049.1, H97837.1,
AI131196.1, AI184641.1, AI754673.1, AI139064.1, AI142447.1, AI374783.1, AI204302.1, AA772102.1, AA435767.1,
AI659941.1, AA860292.1, AI569647.1, AA706309.1, AA732402.1, AA706694.1, AA192742.1, N56938.1, AA766582.1,
AA171536.1, N59159.1, AI336886.1, N49858.1, AA994358.1, M191899.1, N47550.1, AA074753.1, N30433.1,
AA536150.1, AI348314.1, AI342660.1, N29328.1, AA401497.1, AA854769.1, AI220586.1, AI025515.1, AA936114.1,
AA825278.1, AA492553.1, N77882.1, AA804953.1, AW068965.1, AA860331.1, N89882.1, AA769019.1, N47895.1,
N63879.1, Z39560.1, AA805421.1, W73239.1, N66463.1, T62952.1, AI093651.1, AW839754.1, R68907.1, W57588.1,
AI970730.1, W92205.1, AA602432.1, F10765.1, AA074836.1, R22227.1, AA255616.1, AA987948.1, P03184.1,
AA852934.1, H04250.1, R42968.1, AW503224.1, R67269.1, AI621152.1, AI536774.1, AW503670.1, H83900.1,
AI743459.1, AW439253.1, AI571914.1, T92192.1, AW264100.1, AW172934.1, F04772.1, AI588862.1, H56904.1,
R40975.1, AI915335.1, AW467646.1, AI678364.1, R43639.1, AI625453.1, AA643894.1, AI560721.1, R00485.1,
W73294.1, AW270022.1, AA397947.1, AC015956.3, AC021927.3, AP001381.1, AL121900.7, AL121780.3, AC026570.2,
AL354706.2, AC046148.2, AC027566.1, AC008658.2, AC015405.1, AL133499.1, AC016956.6, AC024153.10,
AC008019.37, AC027489.2, AC016994.3, AC025130.2, AC016956.5, AL356377.1, AL121759.19, AL162381.3,
AL139094.5, AC068908.2, AC069028.4, AC023057.6, AC012117.3, AC046161.2, AC010631.4, AC009118.6,
AC021471.2, AC009639.3, AC026967.2, AC027067.2, AC027059.2, AC026505.3, AC022050.2, AC019334.3,
AC016910.2, AC012585.4, AC009384.5, AC012071.3, AC017069.3, AC012855.1, AC015230.1, AL356140.3,
AL353578.2, AL158146.2, AL160057.4, AL162759.1, AL136975.1, AP001392.1,
SEQ ID NO. 178
NGO-Br-63
MK467/T3 5'

NM_014731.1, AB011124.1, AF123659.1, AF123658.1, AF123657.1, AF123656.1, AF123655.1, AF123653.1,
AL133215.16, AE003506.1, NM_003980.1, AJ242502.1, AJ242501.1, AL023284.1, X73882.1, AF130782.1, AF190465.1,
AC006544.19, AC005033.1, AC003065.1, AC006985.2, U84269.1, U84268.1, AC003047.1, AL031295.1, AE001862.1,
U51197.1, AC004231.1, AP000279.1, AB004043.1, AB004042.1, AB002339.1, AW416906.1, D56085.1, AW263065.1,
AJ281091.1, AI911142.1, AI501468.1, W45377.1, AW530214.1, AW140903.1, AA819761.1, AI293560.1, AI230840.1,
AA799815.1, C25135.1, AA086491.1, AW727488.1, AW657062.1, AW648093.1, AW581571.1, AW576745.1,
AV306266.1, AW138828.1, AW045957.1, AI892415.1, AV014939.1, M325725.1, AI069094.1, AA727234.1,
AA400580.1, AL121891.18, AC025853.2, AC012162.9, AC012693.1, AC009216.8, AC011498.4, AC017241.1,
AC027118.2, AC026497.1, AC009850.9, AC014014.1, AC017674.1, AC012600.4, AC012515.11, AC010189.4,
AC008129.10, AC007834.20, AC023501.7, AC012293.9, AC044820.2, AC068126.2, AC068588.1, AC068557.1,
AC027764.2, AC062037.2, AC024948.2, AC055811.1, AC024474.2, AC021467.2, AC027267.1, AC026244.1,
AC010121.6, AC015867.2, AC016439.4, AC016753.4, AC011575.3, AC012600.3, AC013934.1, AC013499.2,
AC011135.2, AL138753.3, AL136990.14, AL136439.2, AL138757.4, AL137025.2, AL138955.1, AL136104.3,
AL022335.6, AP001979.1,

TABLE 1-continued

Sequence homologies (GenBank Accession Numbers)

SEQ ID NO. 179
NGO-Br-63
MK467/T7 3'

NM_014731.1, AB011124.1, AC019209.3, AC005829.1, AF045453.1, AL135999.2, AL132719.2, Z98946.15,
AL021326.1, AC010385.3, AC007115.1, AC002477.1, NM_0126541 AF179633.1, AL121809.4, AL035460.15,
M85300.1, D14905.1, D14904.1, AW134487.1, AW005916.1, AI918105.1, AI369140.1, AI362807.1, AI536952.1,
AA233070.1, AI800560.1, AI570845.1, AI084111.1, AI805727.1, AI566887.1, AI885796.1, AW205146.1, AA631005.1,
AW088686.1, Z38359.1, AI570882.1, AI889744.1, F03249.1, T23438.1, AI093242.1, AII51303.1, H64737.1, T91286.1,
AA682753.1, AW057576.1, AW752274.1, AA577015.1, AA319634.1, H65227.1, AW246038.1, AA862950.1, AI573262.1,
AA639497.1, AI148651.1, AI129016.1,R44479.1, AW874175.1, AI849112.1, AA118865.1, W539461AW6113721
AW359586.1, W96834.1, AA339527.1, AA320970.1, AA317924.1, AW523114.1, AI229250.1, AI229142.1, AA943809.1,
AW658594.1, AW655764.1, AW426231.1, AW359271.1, AI863241.1, AI007273.1, AA832546.1, AA619805.1,
AA571164.1, AA422555.1, AA260212.1, AA259669.1, AA240477.1, W16289.1, H51681.1, AL121891.18, AC008133.2,
AC021420.3, AC025898.2, AC009608.2, AC024225.8, AC024224.6, AC025194.2, AC016018.7, AL355482.1,
AC024105.7, AC023504.4, AC064837.2, AC025772.3, AC012636.3, AC034138.2, AC021355.3, AC027688.2,
AC023819.3, AC015478.3, AC016868.4, AC009962.3, AC012505.3, AL354.652.3, AL355884.2, AC009453.7,
AC046135.4, AC068633.3, AC026084.2, AC026285.4, AC026792.2, AC011356.3, AC024230.3, AC024537.2,
AC027216.2, AC027526.2, AC026423.3, AC027685.2, AC015928.4, AC011033.3, AC011957.2, AC016180.5,
AC011213.4, AC023920.2, AC016483.6, AC023291.2, AC005052.1, AL356154.2, AL355590.2, AL354726.2,
AL355476.1, AL353589.1, AL157375.1, AP001855.1, AP000752.1, AP000721.1,

SEQ ID NO. 180
NGO-Br-64
MK731/T3 5'

NM_014963.1, AB023180.1, AC005390.1, AF060974.1, AC007246.3, AL049754.1, AE001274.1, AJ242840.1,
AJ242839.1, Y15791.1, AE003835.1, AE003596.1, AC005290.3, AF117761.1, AP117760.1, NM_0005062 AC007655.1,
U73167.1, U90094.1, M24461.1, AL133224.2, AL121756.14, U50596.1, U00012.1, AL022374.1, X82071.1, A8001030.1,
V00595.1, J00307.1, M33031.1, D17389.1, X54794.1, M60789.1, Y10403.1, AW410223.1, AW468990.1, AI827893.1,
AW081199.1, AA977476.1, AL045506.1, AL079747.1, AW206971.1, AW073064.1, AI559848.1, AI760801.1,
AI430503.1, AA245512.1, AA245370.1, W62920.1, AW729115.1, AW668796.1, AW431830.1, AW348976.1,
AW649811.1, AW623969.1, AW056157.1, AI987383.1, AI941796.1, AI896465.1, AI691275.1, M670672.1, AI465663.1,
AI456906.1, AI397644.1, AI054620.1, AA855993.1, C32683.1, AA354150.1, AA334812.1, AA286992.1, H69659.1,
H59101.1, AC011474.2, AC020781.4, AC020582.3, AC068633.3, AC032027.2, AC048370.2, AC012334.2, AC008713.5,
AC016573.4, AC025868.2, AC023826.2, AC018445.3, AC019356.3, AC027817.1, AC012286.2, AC007524.2,
AC026086.2, AC023356.4, AC011951.3, AC015930.3, AC012568.3, AC012374.9, AC024610.1, AC010011.3,
AC012454.3, AC013279.3, AC013750.4, AC020372.1, AC013563.2, AC017853.1, AC007471.3, AC007597.2,
AC007503.1, AL356138.3, AL138720.5, AL137162.5, AL137225.1,1, AL162499.3, AP001337.1,

SEQ ID NO. 181
NGO-Br-64
MK731/T7 3')

AC005390.1, NM_014963.1, AB023180.1, AC002351.1, Z82215.1, AE003544.1, NM_004474.1, NM_000758.1,
AC005950.1, U37501.1, AF042832.1, AC004511.1, AC003675.1, AL163299.2, AC001228.1, AL050318.12, Z85994.1,
AJ006345.1, M13207.1, AP001754.1, AP001062.1, X03021.1, M11220.1, M10663.1, M28860.1, M28859.1, AC068783.2,
AE002501.1, AC007537.3, AC005261.1, AL162756.2, AL122127.3, X97051.1, X17215.1, X57133.1, X16489.1,
U18978.1, AB019441.1, X13972.1, M37277.1, AI200815.1, AI417909.1, AI459189.1, AI560887.1, AW270083.1,
AI564758.1, AI745070.1, AI355293.1, AI815176.1, AL047897.1, AL047898.1, AW474741.1, M4.69279.1, AI359252.1,
AA722975.1, AA444008.1, AI220310.1, AI624704.1, AI289062.1, AI623674.1, AL045507.2, AA456471.1, Z25344.1,
AA444037.1, AA427461.1, R96945.1, AW472864.1, AA654248.1, AA456804.1, AA427462.1, AA954685.1, AI932512.1,
AA485597.1, AI433817.1, AA485433.1, AA454577.1, AA457134.1, T30158.1, AA476273.1, AW138346.1, AA464482.1,
T95376.1, T95296.1, AA299621.1, AA293227.1, AI866076.1, AI801586.1, AA884991.1, AA435961.1, AW013846.1,
AW410224.1, AI391545.1, AA971658.1, AA932895.1, AW431713.1, AW547208.1, AW345308.1, AI085206.1,
AI022933.1, AI912784.1, AI677936.1, AI655452.1, AA096946.1, T291160.1, AW749596.1, AW213795.1, AW207707.1,
AW005369.1, AV131761.1, AV062291.1, AI695173.1, AI524311.1, AI508690.1, AI462638.1, AI417791.1, AI232789.1,
AI072326.1, AA288479.1, AA135536.1, W73276.1, W03892.1, D51085.1, T33074.1, AL162423.2, AC016525.3,
AC018930.3, AC010033.7, AC034216.3, AC026699.2, AC009175.3, AC010590.4, AC011361.3, AC021424.3,
AC013791.3, AC011182.3, AC018891.2, AC009899.5, AC023171.1, AC022754.1, AC013287.6, AC016743.3,
AC021389.1, AC014953.1, AC003656.1, AP001356.1, AC016968.11, AC015545.10, AC024097.8, AC022296.8,
AC037471.2, AC025468.3, AC025460.3, AC024075.3, AC010378.3, AC008681.5, AC024293.2, AC023484.2,
AC021328.3, AC019345.3, AC022051.3, AC018427.3, AC021200.4, AC011281.3, AC027171.1, AC024951.9,
AC021585.3, AC017096.2, AC011140.3, AC009575.4, AC016968.10, AC015545.9, AC016757.3, AC010136.3,
AC013567.2, AC009647.2, AC010782.1, AL035662.50, AL136079.3, AL157939.3, AL158817.2, AL158143.1,

SEQ ID NO. 182
NGO-Br-65
MK385/T3 5'

AF086824.1, U39904.1, AF039218.1, AF070066.1, AC004811.2, AC002563.1, NM_015239.1, AK001544.1, AC007023.3,
AC007078.3, AC000039.3, AC006480.3, AC005488.2, AC005088.2, AF030453.1, AL121823.12, AL161571.2,
AL022326.1, AL078579.1, L09233.1, AE003628.1, AC005537.2, AC005036.1, AC007038.3, AC007451.1, AC006254.10,
AF063424.1, AF092090.1, AC005359.1, AC000378.1, AL161513.2, AL035703.20, Z75543.1, AL035681.13, Z93020.1,
X59046.1, X65624.1, AB037724.1, M22462.1, AW449442.1, AW444459.1, AI826767.1, AI674481.1, AA570498.1,
H62116.1, AW760341.1, AW733957.1, AW598733.1, AW459885.1, AU082470.1, AV403875.1, AW325533.1,
AW325530.1, AW162177.1, AW149411.1, AW076876.1, AW076660.1, AI924223.1, AI510359.1, AA968035.1,
AA508904.1, AA508038.1, AA236748.1, AA177241.1, AA140828.1, AA116487.1, AA107365.1, W62286.1, H16776.1,
T18197.1, AC026363.3, AC026765.5, AL157828.5, AC012032.11, AC023923.2, AL159156.4, AL157362.2, AC019315.2,
AL139429.4, AC019071.3, AC025232.3, AC023593.3, AC018720.3, AC012406.3, AC023811.7, AC005236.3,

TABLE 1-continued

Sequence homologies (GenBank Accession Numbers)

AC004980.2, AC007674.2, AC026507.1, AC016294.2, AC022253.2, AL139182.14, AL137118.8, AL162387.3, AL161642.3, AL049770.1, AP001809.1, AC009774.4, AC021064.7, AC024505.3, AC023493.6, AC026418.2, AC024991.2, AC068482.1, AC027104.2, AC023170.3, AC019063.3, AC019043.3, AC027184.2, AC058808.1, AC026043.3, AC018513.3, AC026002.2, AC019356.3, AC016875.3, AC011952.4, AC009933.5, AC020796.2, AC018887.4, AC022245.3, AC016513.2, AC011009.4, AC022182.3, AC012306.3, AC016245.3, AC020201.1, AC016521.1, AF162757.1, AL133268.6, AL121955.9, AL136114.2, AL136159.4, AL353762.3, AL354720.3, AL355526.2, AL161908.3, AL160400.3, AL138896.2, AL137838.2, AL133167.1, AL138689.1,

SEQ ID NO. 183
NGO-Br-65
MK385/T7 3'

AC002563.1, AB023166.1, U75698.1, U93872.1, AP000542.1, AE003597.1, AC004506.1, AC004695.1, AL049781.4, AL034404.1, X58358.1, AP001819.1, AI861788.1, H10788.1, AW386741.1, AW581596.1, AW386738.1, AA308642.1, N57796.1, AI933041.1, AI984971.1, T91324.1, W42440.1, AI933217.1, N57810.1, AI933106.1, R50756.1, R44891.1, H79564.1, H63135.1, AA353105.1, AA224531.1, AI861826.1, AI245941.1, AW054833.1, AA778789.1, AI806134.1, AW483290.1, AW416772.1, AI936328.1, AA379967.1, AA677294.1, AW047976.1, AW047308.1, AW046893.1, AA617920.1, AA546601.1, AW046868.1, AA822334.1, W78614.1, AI183534.1, AW525869.1, AW665288.1, AA957183.1, AI807388.1, AI228556.1, AI698168.1, AI102448.1, AA955912.1, AI017868.1, AI767064.1, AW797442.1, AW859870.1, AW248416.1, AW117872.1, AC026363.3, AC023264.2, AC069045.1, AC027398.2, AC009268.2, AC024485.2, AC022188.3, AC024111.6, AC011138.2, AC024217.6, AC022132.4, AC024927.2, AC023641.2, AC034147.4, AC013447.3, AC025690.3, AC019311.4, AC023974.2, AC023205.2, AC022460.2, AC018349.2, AC017535.1, AC010689.2, AC004064.1, AL118502.34, AL139241.4, AL138693.6, AL161939.2, AL157716.2, AC001235.1, AP000452.2, AP001833.1,

SEQ ID NO. 184
NGO-Br-66
MK805/T3 5'

U73200.1, AB000214.1, AC003080.1, AC002395.1, AC005244.1, Z68279.1, AC007327.1, AC005817.7, AC007665.24, AC008266.3, AE003615.1, AE003580.1, NM_010559.1, AC004615.1, AF140707.1, NM_003688.1, AF130357.1, AC004893.1, AC005839.1, AF111102.1, AC005807.1, AC005855.1, U58494.1, AC005356.1, AC003052.1, AC005211.1, AC004598.1, M17551.1, AF035582.1, AF032119.1, AJ403418.1, AF027865.1, X97915.1, AC002094.1, AJ290445.1, AL021127.2, AL080241.14, Z83844.5, AL031347.1, U70381.1, U70380.1, U26425.1, X51976.1, X98188.1, X01709.1, X91192.1, AB029009.1, M27972.1, M18252.1, M36323.1, L35243.1, AB011297.1, AB011096.1, U08129.1, AL048447.2, AA378192.1, AA312335.1, AW501959.1, AA675911.1, AA015476.1, AA220385.1, AA681477.1, AW321789.1, AW701965.1, AW171289.1, AW140423.1, AI618679.1, AI617588.1, AI545690.1, AI416377.1, AW727131.1, AI878211.1 AA867310.1, AW822989.1, AW822908.1, AW140419.1, AW107372.1, AI876330.1, AI876315.1, AI787888.1, AI673281.1, AI661565.1, AI647986.1, AI596598.1, M593550.1, AI563647.1, AI448821.1, AI429489.1, AI416269.1, AI316550.1, AI286579.1, AI272572.1, AI272468.1, AI272432.1, AI265094.1, AI265081.1, AI265039.1, AI265016.1, AI227615.1, AI098293.1, AI097946.1, AU017425.1, AU016228.1, AU014817.1, AA983005.1, AA981167.1, AA930951.1, AA920957.1, AA920358.1, AA920053.1, AA919936.1, AA896813.1, AA896091.1, AA896033.1, AA896016.1, AA867305.1, AA797842.1, AA791920.1, AA734060.1, AA672803.1, AA656916.1, AA647396.1, AA561026.1, AA432827.1, AA415676.1, AA239702.1, AA197111.1, AA118415.1, AA104979.1, AA104928.1, AA045964.1, AA014354.1, W38611.1, H93255.1, H89667.1, R15163.1, AC069071.2, AC018473.10, AC007775.2, AC025911.2, AC026386.4, AC024042.3, AC005805.1, AC002405.1, AC055890.2, AC021494.3, AC022701.1, AL355994.1, AL121750.3, AP000780.1,

SEQ ID NO. 185
NGO-Br-66
MK805/T7 3'

AB020671.1, D23673.1, D26154.1, U73200.1, AD001527.1, AC003003.1, AF048729.1, AL353012.1, AL096799.4, AJ011517.1, U66909.1, AE003569.1, AC007243.3, AC005071.2, NC_001224.1, AC007284.4, AC007514.5, AC002401.1, AF055066.1, AL163218.2, AJ011856.1, Z82195.1, AL031985.10, V00695.1, L36887.1, AP000521.1, AB023058.1, AC007040.2, AC005060.2, AC005353.1, Z98551.1, AL035475.6, AL031390.4, AC009233.3, AC020717.3, AF185568.1, U82670.2, AE003491.1, AC004553.1, A0002540.1, AF030694.2, AF214529.1, AC004992.1, AC004998.2, AC004999.1, AC007077.2, AC007402.3, AF006055.1, AC005081.2, AF052006.1, AC004814.2, AC006275.1, AE001368.1, AC000084.1, AC005031.1, U80017.1, AF045555.1, AC003968.1, AL033528.19, AL033385.1, AL034548.25, AL121601.13, AL031171.1, Z84486.1, Z93018.1, AL008734.10, Z84718.2, Z83841.1, Z92542.2, AL009181.1, U46165.1, AL008983.1, L36890.1, AP000211.1, AP000150.1, AP000138.1, AP000563.1, AP000224.1, AP000133.1, AP000086.1, AP000009.2, AB020863.1, M742600.1, AW409781.1, AA487042.1, AI570591.1, AI052677.1, AW189149.1, AA732243.1, AI342608.1, AA813983.1, AI864433.1, AL121497.1, AI313170.1, AA535345.1, AI819339.1, AI140858.1, AA463855.1, AA622061.1, AW071972.1, AI039825.1, AI739551.1, AI681889.1, N63033.1, AI916806.1, AI189978.1, AA812039.1, AW009437.1, AI926737.1, AA551298.1, AA128822.1, AI222960.1, AI656010.1, AI147461.1, AI367859.1, AA732922.1, AI335920.1, AA405100.1, AL039337.2, AA602783.1, AI138662.1, AI128055.1, AI288513.1, AI192368.1, AA514278.1, AW009113.1, AI222961.1, AI929221.1, AA128823.1, W95443.1, AI804032.1, R53599.1, AA625309.1, AI308061.1, AI308050.1, AA604594.1, AW393654.1, N68947.1, AI570799.1, AW021963.1, AW419279.1, N34337.1, AI681778.1, T70294.1, AA628356.1, AA040382.1, H66939.1, AA497027.1, AW816672.1, AI332322.1, AA758762.1, R83381.1, AA026077.1, AA349890.1, AI301205.1, AI825535.1, R92218.1, AA829906.1, AA626936.1, W95788.1, AA861469.1, AI085101.1, AA576806.1, N51568.1, AA761610.1, AA040476.1, T77759.1, AA923625.1, AI090324.1, AA410392.1, R86315.1, AI125301.1, AA911222.1, H44545.1, T47795.1, AW630895.1, AI039856.1, AI344296.1, AI978577.1, H42397.1, P77760.1, AA928570.1, AC007775.2, AC015847.1, AC069071.2, AC015849.2, AC018473.10, AC024725.2, AC024710.2, AC055811.1, AC011374.4, AC016098.3, AC005308.6, AC006286.13, AL354739.3, AL122018.22, AL162491.3, AC025511.2, AC011461.2, AC005073.2, AC012198.3, AC019092.2, AC007926.6, AC007862.4, AC010999.2, AC015652.6, AC021574.3, AC025994.2, AC021786.2, AC025025.2, AC005140.6, AC004153.5, AC023441.2, AC020966.1, AC013409.3, AC005193.2, AL162417.1, AC036200.2, AC010397.5, AC008742.6, AC008813.4, AC027733.2, AC009977.3, AC026379.3, AC026549.2, AC024986.2, AC005505.6, AC015623.3, AC016071.2, AC005504.3, AC004710.3, AL122035.2, AP001392.1, AP001104.1, AC069126.1, AC005842.6, AC069111.1, AC013553.10, AC062030.2, AC027632.4, AC068850.1, AC022150.4, AC016586.4,

TABLE 1-continued

Sequence homologies (GenBank Accession Numbers)

AC022147.4, AC009143.4, AC027548.2, AC067898.1, AC016385.3, AC025481.2, AC025928.2, AC027272.2,
AC027586.1, AC010787.3, AC024969.2, AC012428.4, AC017030.4, AC021305.3, AC025337.1, AC022928.1,
AC018879.3, AC011694.2, AL355385.4, AL109825.17, AL161911.3, AL157831.2, AL121747.21, AL109815.2,
AL096782.3,
SEQ ID NO. 186
NGO-Br.67
MK495/T3 5'

U13369.1, X13993.1, AA161421.1, AA214215.1, AA166833.1, AA166827.1, AA085249.1, AC025630.1, AC010554.1,
AC011630.2, AL355134.1, AL158197.6, AC026915.1, AC068881.1, AC023572.3, AC018688.4, AC064866.2,
AC064825.3, AC010970.2,
SEQ ID NO. 187
NGO-Br-67
MK495/T7 3'

U20938.1, NM_000110.2, U09178.1, AB003063.1, U20981.1, U09179.1, D85035.1, U39742.1, U56248.1, AF220294.1,
AE003647.1, AE003413.1, AE002206.1, AC007501.2, AC004535.1, AC004945.1, AC006977.3, AE001615.1,
AC004962.1, AC002981.1, AC002546.1, AC002436.1, AL050342.42, AL139074.2, U88171.1, U39654.1, AP000003.1,
AI752078.1, AI786904.1, AI746780.1, W49558.1, AI119026.1, W03174.1, AW630700.1, AI931647.1, AU076411.1,
AW175385.1, AW174937.1, D36086.1, AW829780.1, AW829729.1, AW829453.1, AW828679.1, AW828317.1,
AW421789.1, AI765768.1, AW859693.1, AW531377.1, AV008918.1, AI599543.1, AA926321.1 AA818512.1,
AA891593.1, AA851914.1, AA886930.1, R04419.1, AL354881.3, AL162575.4, AC006448.10, AC008603.4, AL137159.1,
AC008961.4, AC008561.3, AC021003.4, AL356266.2, AL133548.6, AP002006.1, AC068969.1, AC055784.2,
AC036131.2, AC011333.4, AC034128.2, AC009579.3, AC027374.2, AC060828.3, AC025091.3, AC067805.1,
AC046147.2, AC027618.2, AC015953.3, AC024606.2, AC025821.2, AC016310.5, AC011155.4, AC023814.2,
AC023246.2, AC022206.2, AC025338.1, AC015567.3, AC019239.3, AC007490.3, AC019133.3, AC020173.1,
AC006846.1, AL355493.2, AL355498.2, AL158210.6, AL356101.1, AL353759.3, AL161740.4, AL139243.3, AL139244.2,
AL138920.2, AL139000.2, AP001934.1, AP001484.1,
SEQ ID NO. 188
NGO-Br-69
MK319/T3 5'

NM_007186.1, AF049105.1, AL121586.28, AF022655.1, NM_008383.1, U33198.1, AE003526.1, AC006933.3,
AC006486.1, U34932.1, AC004877.1, AF072845.1, AC005602.1, AD000864.1, AD000833.1, L08845.1, AE003795.1,
U94409.1, AI124555.1, AW060335.1, AA647911.1, W83246.1, AW732245.1, AW590218.1, AW340426.1, AI989500.1,
AI983119.1, AI808699.1, AI654406.1, AI653050.1, AI650974.1, AI638614.1, AI637922.1, AA977540.1, AW626159.1,
AW622831.1, AW622685.1, AJ397298.1, AW504867.1, AW399321.1, AW405716.1, AW096606.1, AW094388.1,
AW094030.1, AI912988.1, AI886821.1, AI823876.1, AI782590.1, AI780656.1, AI775035.1, AI771616.1, AI695784.1,
AI539054.1, AI488077.1, AI486997.1, AI435874.1, AI391305.1, AI382942.1, AI288287.1, AI277512.1, D89319.1,
AA824970.1, AA824942.1, C23550.1, AA243659.1, AA131248.1, AA130548.1, C01658.1, W18282.1, L44352.1,
D51291.1, R51070.1, T23439.1, AL139226.14, AC010751.3, AC010688.4, AC014935.1, AC010690.1, AC023065.3,
AC021858.2, AL158835.3, AL133230.20, AL353653.5, AL139330.5, AL135907.3, AL353609.2, AC069242.1,
AC025177.3, AC025531.2, AC011432.2, AC012277.2, AC023303.2, AL157888.2, AL139237.4,
SEQ ID NO. 189
NGO-Br-69
MK319/T7 3'

NM_007186.1, AF049105.1, AL121586.28, AF022655.1, NM_008383.1, U33198.1, AC004691.1, AE003666.1,
AC002503.1, M34989.1, X14428.1, AE003817.1, AE003513.1, AC004931.1, AC005977.3, AC005245.1, AL163304.2,
AI004834.1, AL009174.1, AP001759.1, AP001101.1, X75910.1, AF257304.1, AF257303.1, AC006533.7,
AF206287.1, NM_009307.1, AC007463.3, AE001862.1, AF092918.1, AC003689.1, AC004134.1, AF020554.1,
AL161540.2, AL161539.2, AL050135.1, U60780.1, AL031686.2, Z97337.2, Z99122.1, U22062.1, X80301.1, X85786.1,
M86250.1, D37793.1, L03208.1, D43752.1, Z92952.1, D85027.1, AL037087.2, AI872306.1, AI811998.1, AI401068.1,
AA613882.1, AI687495.1, AI224019.1, AA970425.1, AW083819.1, AA595119.1, AW084657.1, AI817733.1, AI419425.1,
AI240622.1, R87989.1, AI204529.1, AI000880.1, AA848087.1, Z40915.1, AA502324.1, AW078517.1, AI699218.1,
AA729465.1, T85911.1, R88035.1, AW504249.1, AW133062.1, AW435751.1, AW346610.1, M534994.1, AI534415.1,
AI530805.1, M519460.1, AI512712.1, AI456969.1, AI455689.1, AI404669.1, AI388686.1, AI388197.1, AI388073.1,
AI387697.1, AI387259.1, AI386601.1, AI192646.1, AI135562.1, AI135091.1, AI107565.1, AI063523.1, AI063307.1,
AA942336.1, AA941421.1, AA201182.1, AA392346.1, W82939.1, AW784983.1, AW607628.1, AW454537.1,
AW029340.1, AW024754.1, AI991341.1, AI937337.1, AI863172.1, AI717513.1, P28098.1, AI523953.1, AI343828.1,
AI340266.1, AI032053.1, AI024499.1, AA991616.1, AA937835.1, AA889325.1, AA872357.1, AA812821.1, AA805252.1,
AA746136.1, AA722399.1, AA660763.1, AA586676.1, AA532648.1, AA527348.1, AA523469.1, AA504479.1,
AA417368.1, AA405813.1, AA262932.1, AA228934.1, AA055130.1, N30852.1, H94195.1, D63281.1, R72540.1,
AL139226.14, AL122019.21, AC027740.2, AC022067.2, AC021359.2, AC014791.1, AL162382.2, AP000491.1,
AC010759.2, AC046181.1, AC026053.2, AC022262.3, AC024341.2, AC020964.1, AC015349.1, AC020328.1,
AC010671.7, AF161326.1, AL162271.2, AC020923.4, AC008906.3, AC008790.4, AC011459.2, AC009544.4,
AC053476.1, AC019325.3, AC016841.2, AC011568.3, A0009565.7, AC022047.4, AC021225.3, AC012354.3,
AL162234.3, AL157949.2, AL138699.1, AP000451.2, AP001384.1, AP001163.1, AP000666.1,
SEQ ID NO. 190
NGO-Br-70
MK061/T3 5'

Z36816.1, AC008469.4, U91320.1, AL117630.1, Z82205.1, ZS0112.1, X82322.1, AB018295.1, AF142100.1, AC008498.3,
AE002153.1, AC004830.1, AC004738.1, Z78419.1, AL034397.1, X63598.1, L14017.1, Y13096.1, Y13095.1, X54660.1,
Y14051.1, D86934.1, AB033763.2, L14020.1, AL046916.1, AW732487.1, AA088822.1, H50443.1, T65364.1,
AA112796.1, F11994.1, R11879.1, AW414271.1, AW414220.1, AA075824.1, A363903.1, AW786911.1, AA896188.1,
AW403711.1, H19785.1, AI197257.1, T65515.1, AW401567.1, AL047058.1, R55598.1, AW143393.1, AW375060.1,

TABLE 1-continued

Sequence homologies (GenBank Accession Numbers)

AI591958.1, F11904.1, AA742633.1, AA517314.1, W85360.1, T08516.1, AA184178.1, D28616.1, AA000364.1,
AW796180.1, AW401580.1, T16871.1, AA739011.1, AI153477.1, W21846.1, AW785749.1, AA053446.1, D21680.1,
AW390748.1, AA032616.1, AW401807.1, AW801635.1, AA027649.1, Z45691.1, F08352.1, AI410833.1, AW5 57036.1,
AA895817.1, AW546958.1, AW575180.1, AW640041.1, AW555199.1, AJ397620.1, AA018126.1, AJ397023.1, R09436.1,
AW522370.1, AJ395743.1, A3392332.1, AW269432.1, AW169948.1, AI914378.1, AL046089.1, AV106169.1,
AI371352.1, AA922035.1, AA707531.1, N91137.1, R45445.1, AW815118.1, AW163019.1, AI522333.1, AA965117.1,
AA317592.1, H10898.1, R16064.1, AC023861.2, AC025415.3, AC067823.2, AC026400.2, AC008785.3, AC020710.4,
AC024452.2, AC026821.2, AC021956.3, AC023442.2, AL355499.5, AC023449.3, AC036143.2, AC025544.3,
AC011509.5, AC008691.4, AC023020.3, AC048481.1, AC024053.2, AC008703.3, AC027678.1, AC023812.3,
AC015900.2, AC009637.3, AC025221.2, AC025565.2, AC019141.3, AC018421.3, AC021603.2, AC023380.1,
AC022390.1, AL356215.1, AL355972.2, AL139276.2, AL136989.4, AL161742.3, AL353713.1, AL158204.2, AL158143.1,
AL137845.1,
SEQ ID NO. 191
NGO-Br-70
MK061/T7 3'

AF035296.1, AC010889.2, AF038149.1, Z70685.1, AE003463.1, AC006317.3, AF200688.1, AC008041.5, AC005684.1,
AC004601.1, AL133451.1, AL050347.1, X55146.1, Z73987.1, AW471383.1, AW294879.1, AI827389.1, AI433239.1,
AW575180.1, AW574507.1, AI936491.1, AI803377.1, AW575276.1, AW574501.1, AW574595.1, AW081903.1,
AI017541.1, AW575023.1, AW474843.1, AW269983.1, AI143057.1, AW662466.1, AW149715.1, AI818173.1,
AW027629.1, AI129967.1, AI084109.1, AA629401.1, AI032340.1, AA775878.1, AI734859.1, AI688609.1, AA134114.1,
AA088684.1, AI537873.1, AW474193.1, AA709474.1, AW087318.1, AA052969.1, T17399.1, AW244157.1, AI198524.1,
AA455953.1, AA662286.1, T65434.1, N23103.1, M500354.1, I77285.1, R48306.1, T87060.1, AW079744.1, T16870.1,
AA242771.1, AA364661.1, AA725410.1, AA888835.1, AW183474.1, R48408.1, R55361.1, AI952437.1, AI383126.1,
AA772585.1, R17756.1, R53154.1, AI468078.1, T83615.1, AA740428.1, AA989632.1, AA776777.1, AW088969.1,
AA970686.1, AW467672.1, F09551.1, R84473.1, AA053446.1, AW839837.1, AW801635.1, R40543.1, AA242901.1,
AW375060.1, W21846.1, AW295371.1, AA485133.1, AA281393.1, AW834883.1, AW426950.1, AW335961.1,
AI953843.1, AI935134.1, AI817633.1, AI808163.1, AA924764.1, AI370430.1, AA232269.1, AA224090.1, AP001028.3,
AC003094.1, AC025920.8, AC024162.2, AC021006.3, AC020773.3, AC026197.1, AC026181.1, AC020755.2,
AC024159.1, AC068063.2, AC026416.2, AC020942.4, AC067757.1, AC008162.2, AC046179.1, AC027654.1,
AC019099.3, AC024944.2, AC016453.4, AC013350.6, AC024511.2, AC013816.3, AC023176.3, AC016525.3,
AC024911.1, AC023157.4, AC010734.3, AC012167.4, AC008131.1,1, AC020499.1, AC017700.1, AC006100.1,
AL356370.1, AL118519.20, AL138762.5, AL137853.7, AL133388.3, AL354680.4, AL160157.3, AL138848.3,
AL353733.1, AL162430.1, AL157826.2, ,
SEQ ID NO. 192
NGO-Br-70
MK231/T3 5'

Z36816.1, AC006075.1, Z54328.1, AC008469.4, U91320.1, AC003034.1, AF165142.1, AC004987.2, AL137290.1,
AL117630.1, Z83849.1, Z93242.1, Z82205.1, Z50112.1, X82322.1, AB018295.1, AF142100.1, AC005137.1, AE002153.1,
U89337.1, AC005940.3, AC004738.1, AE000895.1, AL163229.2, AL034397.1, X63598.1, L14017.1, Y13096.1,
Y13095.1, X54660.1, Y14051.1, AP001684.1, D86934.1, AB033763.2, AP000705.2, Y11769.1, L14020.1, AL046916.1,
AW732487.1, H50443.1, AA088822.1, T65364.1, AA112796.1, F11994.1, R11879.1, AA075824.1, AW403711.1,
T65515.1, AW414271.1, AW414220.1, AW786911.1, AA363903.1, AA896188.1, AW401567.1, AL047058.1, R55598.1,
H19785.1, AI197257.1, F11904.1, AW143393.1, AW401580.1, AW796180.1, AA517314.1, W85360.1, AA742633.1,
AI591958.1, T08516.1, AW375060.1, AW401807.1, AA184178.1, D28616.1, AA000364.1, T16871.1, F08352.1,
Z45691.1, AW785749.1, D21680.1, AW390748.1, AA739011.1, AI153477.1, AA032616.1, AA027649.1, AA018126.1,
AW403200.1, AW402516.1, W21846.1, AA053446.1, AW402128.1, AI410833.1, AW557036.1, AA895817.1,
AW546958.1, AW640041.1, AW555199.1, AI397620.1, AI254622.1, T31811.1, AI397023.1, AI395743.1, AJ392332.1,
AW269432.1, AW169948.1, AI914378.1, AL046089.1, AV106169.1, AI371352.1, AA922035.1, AA707531.1, N91137.1,
R45445.1, AW815118.1, AW163019.1, AI592661.1, AI522333.1, AI341327.1, AA317592.1, AA184644.1, H10898.1,
R16064.1, AC027678.1, AC022390.1, AC023861.2, AC011591.4, AC022437.2, AC015844.4, AC015875.1, AL157397.2,
AP001926.1, AP001284.1, AP000764.1, AP000614.3, AC025415.3, AC067823.2, AC019331.3, AC026400.2,
AC010324.4, AC020710.4, AC022916.2, AC024452.2, AC027437.2, A0027069.2, AC026008.2, AC022696.3,
AC021956.3, AC023954.2, AC023442.2, AC023241.2, AL355860.1,
SEQ ID NO. 193
NGO-Br-70
MK464/T3 5'

Z36816.1, AK000595.1, Z54328.1, AC006960.1, AC007540.3, Z82205.1, Z50112.1, X82322.1, AF142100.1, AC002380.1,
AE002153.1, AC004738.1, AC005371.1, AJ251829.1, Z85996.1, AL034397.1, X63598.1, L14017.1, Y13096.1, Y13095.1,
X54660.1, Y14051.1, D86934.1, AB033763.2, L14020.1, AL046916.1, AA075824.1, AW403711.1, H50443.1, T65364.1,
AW401567.1, T65515.1, AL047058.1, R55598.1, F11904.1, F11994.1, AW401580.1, AW796180.1, AW732487.1,
AW401807.1, AA088822.1, Z45691.1, AW786911.1, AI197257.1, AA896188.1, AW403200.1, AW402516.1,
AA018126.1, R11879.1, T16871.1, T08516.1, AA517314.1, W85360.1, H19785.1, AA112796.1, T31811.1, AW414220.1,
AW405526.1, AW414271.1, AW143393.1, AA363903.1, AW402128.1, AA027649.1, AA742633.1, AW785749.1,
AI592661.1, F08352.1, AI591958.1, D21680.1, AW390748.1, AW402023.1, AA184644.1, AA184178.1, D76728.1,
D28616.1, AA000364.1, AW640041.1, AJ397620.1, AJ397023.1, AV106169.1, AW815118.1, AW163019.1, AW159142.1,
AW159141.1, AW159140.1, AW158139.1, AW158059.1, AI657929.1, AA317592.1, H10898.1, R16064.1, AC023861.2,
AC025415.3, AC067823.2, AC020710.4, AC024452.2, AC011052.4, AC021956.3, AC023442.2,
SEQ ID NO. 194
NGO-Br-70
MK464/T7 3'

AF035296.1, AE003725.1, AC007053.15, U96104.1, U58920.1, AF038149.1, Z70685.1, D87992.1, AC006317.3,
AC008041.5, AC005684.1, AC004601.1, AL133451.1, AL050347.1, X55146.1, Z73987.1, AW575180.1, AA775878.1,
AW575276.1, AW574595.1, AW575023.1, AW574501.1, AW574507.1, AW294879.1, AI827389.1, AA629401.1,

TABLE 1-continued

Sequence homologies (GenBank Accession Numbers)

AW471383.1, AI433239.1, AI936491.1, AI803377.1, AW149715.1, AW081903.1, AI017541.1, AW474843.1,
AW269983.1, AW027629.1, AI143057.1, AW662466.1, AI818173.1, AI129967.1, AI084109.1, AI032340.1, AI734859.1,
AI688609.1, AA134114.1, AA088684.1, AI537873.1, AW474193.1, AA709474.1, AW087318.1, AA052969.1, I77285.1,
T17399.1, AW244157.1, R53154.1, AI198524.1, AA455953.1, AA662286.1, R48408.1, N23103.1, T65434.1, AI500354.1,
AA053446.1, AW801635.1, AW079744.1, R48306.1, T16870.1, T87060.1, AA364661.1, T83615.1, AA242771.1,
AA725410.1, AA888835.1, AW183474.1, AI952437.1, AI383126.1, R55361.1, AA772585.1, AW839837.1, R17756.1,
AI468078.1, AW375060.1, AW088969.1, AA740428.1, AA989632.1, AA776777.1, W21846.1, AA970686.1, F09551.1,
AW467672.1, R84473.1, AA242901.1, D30911.1, R40543.1, AW479983.1, AW834883.1, AW826181.1, AV417825.1,
AW557036.1, AW555199.1, AW546958.1, AW5Z7142.1, AW491879.1, AW426950.1, AW335961.1, AI229288.1,
AI103583.1, AI155354.1, AI153477.1, AA895817.1, AA739011.1, AA290498.1, AA000364.1, AP001028.3, AC025920.8,
AC024162.2, AC021006.3, AC020773.3, AC026197.1, AC026181.1, AC020755.2, AC024159.1, AC017539.1,
AC006589.3, AC008141.2, AC068063.2, AC067757.1, AC046179.1, AC027654.1, AC019099.3, AC024944.2,
AC016453.4, AC013350.6, AC024511.2, AC013816.3, AC023176.3, AC016525.3, AC024911.1, AC023157.4,
AC010734.3, AC008131.11, AC017700.1, AL356370.1, AL118519.20, AL137853.7, AL133388.3, AL354680.4,
AL138848.3, AL353733.1, AL162430.1, AL157826.2,
SEQ ID NO. 195
NGO-Br-71
MK137/T3 5'

AB025608.1, AB009048.1, D45408.1, AB023029.1, AC005922.1, U64851.1, U92032.1, AJ001535.1, U66525.1,
AB008265.1, AP000495.1, AC007187.4, AE003492.1, AC010125.3, AC002088.1, AC003071.1, AE001774.1,
AC005509.1, A0005900.1, AE001119.1, AC004063.1, AF040653.1, AL353995.1, AL031466.1, AL132715.2,
AL161666.2, U28760.1, AL109609.5, AL031579.1, Z66567.1, Z82211.1, Z99129.1, AL021918.1, AL022159.1,
AJ001088.1, AL041831.1, AA911802.1, AI791494.1, AI791283.1, AW639607.1, AW540750.1, AI553588.1, AI194910.1,
AW565485.1, AW470837.1, AW440357.1, AW106522.1, AV2018191, AL037101.1, AV091786.1, AI444814.1,
AI114364.1, AI002480.1, AA002743.1, AL355146.4, AL161434.3, AL132673.16, AL356292.1, AC027069.2,
AC067734.3, AL161788.4, AC058786.7, AC025936.2, AC046186.2, AC009944.3, AC008459.4, AC026989.2,
AC025669.2, AC026505.3, AC026390.1, AC024422.2, AC021696.3, AC018826.3, AC012525.6, AL157785.2,
AL355332.1, AC062004.2, AC013244.8, AC007943.2, AC027679.1, A0010429.4, AC027741.2, AC026557.2,
AC012349.3, AC020732.3, AC027625.2, AC051630.1, AC026958.2, AC021514.3, AC012148.2, AC022580.2,
AC009680.5, AC010993.10, AC010994.9, AC010730.4, AC010101.4, AC012195.2, AC014437.1, AC010843.8,
AC018408.1, AC011673.2, AC011114.1, AC010132.2, AC007555.1, AC006799.1, AL356357.1, AL356009.2,
AL121954.4, AL139278.2, AL354920.1, AL139397.2, AL162719.1, AL138724.2, AP001954.1, AP001823.1,
SEQ ID NO. 196
NGO-Br-71
MK137/T7 3'

AC006014.2, AC004705.2, AL035652.5, AC044786.2, AE002147.1, AC004848.1, AC007735.2, AC004907.2,
AF107885.2, U67494.1, AL161588.2, AL031986.1, AL022373.1, AI732538.1, AI652638.1, AA505930.1, AA991355.1,
AW235448.1, AL041832.1, AI791494.1, AI791283.1, AL041831.1, AV254980.1, AW552644.1, AV267495.1,
AV264008.1, AV260689.1, AV259564.1, AV258534.1, AV208825.1, AV260910.1, AV264098.1, AW552124.1,
AW317034.1, AA391903.1, AA536375.1, AA536264.1, AV210836.1, AW692176.1, AW438480.1, AJ388903.1,
AW210311.1, AI643503.1, AI545190.1, AI394892.1, AI141264.1, AA497287.1, AA404284.1, AA256257.1, AW567217.1,
AW361948.1, AV267670.1, AU077746.1, AI906249.1, AI901829.1, AV034590.1, M621492.1, AI551985.1, AI395360.1,
AI179945.1, AU030825.1, AA906203.1, AA894271.1, AA852029.1, AA673655.1, C62664.1, C61515.1, AA445695.1,
AA418204.1, AA141341.1, AA104978.1, H11780.1, R13493.1, T81922.1, Z44433.1, AL356292.1, AL355146.4,
AL161434.3, AL132673.16, AL136305.5, AC007943.2, AC011078.2, AL133508.2, AL138763.2, Z93245.1, AC011585.3,
AC018976.2, AC011939.2, AC014847.1, AC022442.3, AC009820.3, AC026491.3, AC022467.4, AC016221.4,
AC021619.3, AL137017.5, AL121715.2, AL133322.3,
SEQ ID NO. 197
NGO-Br-72
MK419/T3 5'

AK000528.1, NM_016123.1, AF155118.1, AL161587.2, M63234.1, AL031135.1, AC005868.1, AL096699.11, X98048.1,
NC_001148.1, AF249887.1, AC002392.2, AE003724.1, AF030694.2, NM_004690.1, AC007313.3, AF164041.1,
AC006559.6, AC007102.4, AF104413.1, AF104414.1, AE001409.1, AF015463.1, AC005220.1, U67476.1, AL161573.2,
AL161572.2, Z68136.2, AL049662.1, AL121783.1, 546763.1, AL021749.1, AL034558.2, U45981.1, Z70720.1, Z73565.1,
Z29667.1, L34028.1, L34027.1, D10606.1, AB011474.1, AB026649.1, M84660.1, M74445.1, U07163.1, H53674.1,
AI967314.1, AW560842.1, AW761247.1, AI794934.1, AI812788.1, AI774138.1, AI772185.1, AW876515.1, AW756795.1,
AW329262.2, AW329038.2, AW649958.1, AW568064.1, AW496536.1, AW348715.1, AW334566.1, AW094252.1,
AI960995.1, AI920205.1, C95693.1, AI594372.1, AA592233.1, H36649.1, T92029.1, T18143.1, AC016143.5,
AC021719.3, AC025567.6, AC026763.5, AC010161.5, AL354696.1, AC022507.12, AC023928.3, AC009671.3,
AC024954.2, AL354815.1, AL121880.15, AC024886.6, AC022072.8, AC031992.2, AC024244.4, AC067883.1,
AC057605.1, AC055596.1, AC055595.1, AC049865.1, AC049836.1, AC048201.1, AC048200.1, AC027086.2,
AC021723.3, AC021849.3, AC013809.3, AC019131.3, AC011308.3, AC013549.2, AC006091.9, AC017374.1,
AL353592.1,
SEQ ID NO. 198
NGO-Br-72
MK419/T7 3'

AK000528.1, NM_016123.1, AF155118.1, AC000118.1, AC004033.3, AC004232.1, AC009509.7, AL049839.3,
AC008521.5, AL021546.1, AC003002.1, AC000378.1, AL096791.12, AC007227.3, AF051976.2, AC005859.1,
AC002565.1, AL132639.2, AC005581.1, AL035400.13, AP000180.1, AP000104.1, Z85987.13, AC005695.1, AC005563.1,
AL049643.12, AC005821.1, AC005088.2, AC005031.1, AL135749.2, AC035249.6, AC004805.1, U52111.1, AL138976.3,
AL121985.13, AC005914.1, AL035588.21, AC005081.2, AC005519.2, AC007993.15, AC005486.2, AL031848.11,
AC004223.1, AF001550.1, AL022318.2, Z98742.5, U62292.1, D84394.1, AP000313.1, AL163305.2, AL121988.10,
AP001760.1, AF030876.1, AC005288.1, AC003663.1, AL121586.28, AC004858.2, AFOU1549.1, Z98200.8, AC002072.1,

TABLE 1-continued

Sequence homologies (GenBank Accession Numbers)

AC004887.2, AC002299.1, AC005874.3, AP134471.1, AC004477.1, AC005730.1, AC006061.1, AL021939.1,
AJ010770.1, AC011462.4, U47924.1, AL035458.35, AL021937.1, AC008011.15, AC009247.1,1, AC004771.1,
AL031133.1, AL049766.14, AC006115.1, AC002369.1, AL133500.2, AP000168.1, AP000053.1, AP000121.1,
AC000134.14, AC005803.1, AC005514.1, AL031281.6, AC004745.1, AL035422.12, AC003007.1, Z95152.1,
AC004983.2, AL163282.2, AL163267.2, AP000045.1, AC005745.4, AC011508.4, AL023879.1, AL022399.2,
AA114131.1, H78605.1, H78687.1, AA084609.1, H07953.1, AA630854.1, AW023111.1, AA501614.1, T74524.1,
AA468505.1, AA614254.1, AI889579.1, AA515939.1, AA515728.1, AA612727.1, N64587.1, AW674631.1, AW069227.1,
AI679002.1, AI634187.1, AI457313.1, AA536040.1, AA485328.1, AI925869.1, AA622801.1, AA602906.1, AA228368.1,
W02749.1, R98218.1, AI653776.1, AI244157.1, AI708005.1, AI421257.1, AW082104.1, AI962030.1, AA715173.1,
AA715075.1, AA664126.1, AA297666.1, AL134940.1, AI733856.1, AA613761.1, AA447247.1, AA347969.1,
AA284247.1, C15363.1, T54783.1, AW151824.1, AI290405.1, AA864603.1, T49633.1, AW151201.1, AW090754.1,
AI933714.1, AW304536.1, AI446336.1, AI278972.1, AA573213.1, AA456924.1, AA303054.1, R93919.1, AW341978.1,
AL118612.1, AA552989.1, AW131356.1, AI754105.1, AA502991.1, T47936.1, AI733523.1, AI310343.1, AA669054.1,
AA563770.1, AW844636.1, AW770827.1, M669421.1, AA847499.1, AS576251.1, AW500684.1, AW192599.1,
AI755214.1, AI754567.1, AI569100.1, AI249688.1, AI187148.1, AI080307.1, AI038304.1, AA584862.1, AW188742.1,
AI077941.1, AA535216.1, T47324.1, AI817230.1, AI525100.1, AI560085.1, AW510513.1, R66121.1, AI904811.1,
AA779075.1, AL043144.2, AA225519.1, AC021719.3, AC016143.5, AL355386.1, AC025262.5, AL356280.2,
AL162411.1, AC008760.4, AC016953.5, AC010807.4, AL139252.2, AC026868.2, AC009470.3, AL353743.1,
AC002993.1, AC009124.4, AC018942.2, AC022826.3, AC023329.2, AL158196.4, AC025278.2, AC021258.3,
AC025395.2, AL158165.3, AL034372.30, AL109806.13, AC037464.2, AC011484.2, AC019194.2, AC016888.4,
AL160010.3, AC016073.2, AC034198.2, AC027631.2, AL139807.5, AC007621.13, AC008812.6, AL162611.4,
AC005995.2, AL121943.14, AC012014.5, AL355490.3, AC037871.4, AL354864.1, AC019071.3, AC026469.3,
AL354720.3, AL158014.4, AC026790.2, AP002016.1, AC008749.4, AC021852.3, AC012236.3, AL121845.18,
AL163051.1, AC061979.2, AC012291.3, AC026160.1, AC024380.2, AC018808.3, AL158827.4, AC016554.5,
AC022554.2, AC006393.6, AC005867.1, AL162584.2, AL161615.2, AL138788.1, AC010607.4, AC026286.2,
AC026817.1, AP001177.1, AC025060.3, AC015714.4, AC011247.3, AL121834.8, AL136450.1, AC013564.3,
AC012451.3, AC021510.2, AC016485.2, AL137186.4, AC162595.5, AL137247.3, AL137856.2, AC025695.3,
AL158152.3, AC068485.1, AC008555.3, AC020697.3, AC010149.4, AL139255.1, AC011501.5, AC008774.3,
AC027551.2, AP001501.1, AC007366.3, AC041047.3, AL136139.5, AP001198.1, AC022410.3,
SEQ ID NO. 199
NGO-Br-73
MK642/T3 5'

AF147338.1, AK000060.1, AE003569.1, AF111426.1, AC007048.4, AC005385.3, U60334.1, AF020802.1, AL163269.2,
Z95889.1, Z83317.1, AP001724.1, AP000687.1, AJ229041.1, AC008526.5, AC000122.1, AC005901.1, AL117327.3,
AP000377.1, AE003526.1, AC007216.2, AC005249.1, U95742.1, AC006933.3, AC004512.1, AL133419.15, AI692537.1,
AW243461.1, AW235223.1, AI671570.1, AW653857.1, AW274251.1, T58078.1, T58198.1, AW485453.1, AW428440.1,
AA918819.1, AA017211.1, AA247593.1, AV347965.1, AV103024.1, T27488.1, AV242595.1, AV341902.1, AV346780.1,
T11529.1, AV245244.1, AV229602.1, AU030011.1, AW575669.1, AW5 729718.1, AW212594.1,
AV376787.1, AV374992.1, AV367312.1, AV340052.1, AV273236.1, AV265359.1, AV250828.1, AV221007.1,
AV219070.1, AV218774.1, AV206725.1, AW066980.1, AI847479.1, M837994.1, AI835991.1, AV159366.1,
AV169546.1, AV152290.1, AV142949.1, AV141913.1, AV130057.1, AV126713.1, AV117344.1, AV115850.1,
AV102420.1, AV095928.1, AV075293.1, AV063673.1, AV057658.1, AV056084.1, AV056034.1, AI747610.1,
AV038768.1, AV030316.1, AV004917.1, AI574942.1, AI550786.1, AI463222.1, AI462153.1, C78201.1, AA423250.1,
AA259531.1, AC015955.4, AP001033.3, AC017914.1, AC012303.2, AL354863.4, AL139010.6, AC027201.2,
AC012893.1, AL161612.4, AL022285.6, Z93065.1, AC017070.3, AC055820.2, AC026195.2, AC016205.4, AC011178.3,
AC012584.5, AC017432.1, AL160257.3, AC008784.5, AC010323.4, AC034299.2, AC034282.2, AC016893.3,
AC032000.1, AC024010.2, AC023809.6, AC022375.1, AL138904.2, AL354990.1,
SEQ ID NO. 200
NGO-Br-73
MK642/T7 3'

AF147338.1, AK000060.1, X80821.1, U60334.1, AE003480.1, AC000I22.1, M96441.1, AC005901.1, AC000044.2,
AC000034.2, AC004984.1, L28955.1, AL133367.2, AL080079.1, Z80901.1, AL033377.2, AI692537.1, AW653857.1,
AA918819.1, AW274009.1, T58078.1, T58198.1, AV349661.1, AV349644.1, AV350717.1, AV328677.1, AW070252.1, AW775904.1,
AW792828.1, AW274009.1, AW193700.1, AL121308.1, AW792476.1, AW910455.1, AI765240.1, AJ567672.1,
AI376609.1, AI351633.1, AI291783.1, AI291446.1, AA652658.1, AA570928.1, AA496039.1, H93102.1, R86033.1,
R77622.1, R68550.1, AW774292.1, AW413948.1, AW155190.1, AW029172.1, AW009281.1, AU069485.1, AU030011.1,
AI182684.1, AI122141.1, AI096187.1, AA839637.1, AA762941.1, AA691770.1, C72277.1, AA548171.1, AA451530.1,
AA423704.1, W29889.1, H44377.1, T11529.1, AC015955.4, AP001033.3, AC021893.10, AC027514.2, AL139010.6,
AP001460.2, AC026658.2, AC027061.2, AF235092.1, AC015631.3, AC023680.2, AC010000.2, AC015395.1,
AL355377.2, AC024702.3, AC016493.3, AC024681.2, AC024087.1, AC011940.3, AC022734.2, AC011916.1,
AC010942.1, AC005000.1, AL161904.2, AL139300.2,
SEQ ID NO. 201
NGO-Br-74
MK7611T3 5'
AE003523.1, AC006257.1, A0005330.1, AL355927.1, U56728.1, AL049766.14, AB037825.1, AK000573.1, AE003832.1,
AE003801.1, AE003785.1, AC002087.1, NM_002172.1, AC004829.2, AC005887.3, U29244.1, AC004293.1, X74470.1,
Z11532.1, X72306.1, V00542.1, AA765066.1, R57163.1, AA896010.1, AA178333.1, C80989.1, AW105563.1,
AA930992.1, C80990.1, C81381.1, AA612483.1, AA383435.1, AW326797.1, AW447131.1, AA681894.1, AW104025.1,
Z36392.1, Z36470.1, AW413469.1, AA684257.1, AW149818.1, AL265028.1, AW781170.1, AI907775.1, AA735139.1,
AA371572.1, AA313662.1, AA299963.1, AA148581.1, AA135264.1, AW774261.1, AW609685.1, AW300461.1,
AI397692.1, AI069165.1, AI06852& 1, AA841557.1, AA755125.1, AA623736.1, AC008795.5, AC008855.4, AC011145.3,
AC012122.2, AC055879.2, AC069189.1, AC017022.3, AC022187.2, AC013500.3, AC019563.1, AL162579.4,
AC026334.3, AC069079.1, AC069026.1, AC027328.2, AC010337.3, AC010472.4, AC008549.4, AC011448.2,
AC026393.2, AC011289.3, AC027094.2, AC025974.2, AC025956.2, AC022823.3, AC017010.2, AC015904.3,
AC013370.5, AC007477.5, AC020693.3, AC022302.3, AC007413.4, AC007330.5, AC017049.3, AC022176.1,

TABLE 1-continued

Sequence homologies (GenBank Accession Numbers)

A0019249.3, AF209070.1, AC018198.1, AC017513.1, AC015178.1, AL353664.3, AL354675.2, AL353690.1, AP001372.1, AP001367.1, AP001103.2, AP001085.2, AP001030.2,
SEQ ID NO. 202
NGO-Br-74
MK761/T7 3'

AC025098.4, AC005560.2, AC027661.1, AC011806.1, AC006257.1, AC005330.1, AL355927.1, U56728.1, AL049766.14, AB037825.1, AX000573.1, AE003801.1, AE003478.1, NM_006496.1, NM_002172.1, AC005887.3, AC009465.5, U29244.1, AC005317.1, AC004293.1, AL023518.2, X74470.1, Z11532.1, V00542.1, X54048.1, AK001973.1, AK001746.1, M27543.1, AB014467.1, J03198.1, AA765066.1, R57163.1, AW105563.1, C80989.1, C80990.1, C81381.1, AA896010.1, AA178333.1, AA930992.1, AA612483.1, AA383435.1, AW104025.1, AA681894.1, AW326797.1, AW447131.1, Z36392.1, Z36470.1, AW413469.1, AA684257.1, AI265028.1, AW149818.1, AI453042.1, AW781170.1, AV349095.1, AV248065.1, AI907775.1, AA735139.1, AA371572.1, AA313662.1, AA299963.1, AA148581.1, AA135264.1, AV211122.1, AI829193.1, AV172729.1, AI766084.1, AI620180.1, AI400167.1, AI397692.1, AI356812.1, AI337030.1, AI269102.1, AI261301.1, AI092059.1, AI033551.1, AI033398.1, AA954839.1, AA838238.1, AA766120.1, AA755125.1, AA736929.1, AA706621.1, AA704130.1, AA652992.1, C72329.1, AA587349.1, AA490356.1, AA235987.1, AA085406.1, AC008795.5, AC008855.4, AC011145.3, AC012122.2, AC022061.2, AC016691.4, AC022960.2, AC009831.3, AC055879.2, AC027133.1, AC017022.3, AC019563.1, AL162579.4, AC027328.2, AC015904.3, AC024016.2, AL355310.3, AL353664.3, AL354675.2, AL139802.3,
SEQ ID NO. 203
NGO-Br-75
MK344/T3 5'

AL157792.2, AL033380.11, U55042.1, X64070.1, AC006607.1, AC006576.15, AF070718.1, AC004703.1, AL122003.17, AB015752.1, AC011309.4, AF030876.1, NM_013369.1, U82695.2, AF031075.1, AP194032.1, AFO81058.1, AF051057.1, AF081056.1, AF081055.1, AF058419.1, U68299.1, U52112.1, AL163298.2, AL080286.16, AL096677.18, L06231.1, X53705.1, AP001059.1, X81326.1, X53709.1, X53708.1, D86115.1, AW650954.1, AL119238.1, AW030498.1, AI661495.1, AA831895.1, AW393793.1, AW393785.1, AW213405.1, AV230556.1, AW124066.1, AI931357.1, AV124496.1, AI631758.1, AI585396.1, AA918201.1, AA890172.1, AA882048.1, AA757981.1, AA538210.1, AA474203.1, AA402070.1, AA199109.1, AA053059.1, R82169.1, R23708.1, AC063%0.2, AC012053.2, AC020661.4, AC023137.2, AC026045.3, AC034236.1, AC016530.3, AC019068.3, AC015557.1, AL138781.3, AL162151.2, AC062006.2, AC044906.2, AC036174.2, AC021165.3, AC023133.2, AC009677.3, AC021462.3, AL353803.1, AL160268.3,
SEQ ID NO. 204
NGO-Br-75
MK344/T7 3'

AL049749.2, Z83733.1, AE003545.1, U97009.1, AC005512.1, Z78018.1, AB036794.1, AC008701.5, AC006319.3, AC004160.1, AC005026.1, AL049859.7, Z69637.1, AL035686.12, AE003804.1, AE003275.1, NC_0023871 U17009.2, AC002066.1, AI133269.1, AL030995.1, AI964952.1, AW847510.1, AW453-459.1, AW125886.1, AI562053.1, AI180354.1, AI130241.1, AW840570.1, AW840396.1, AW795642.1, AW600573.1, AW588022.1, AW455711.1, AW331252.1, AW306566.1, AI913878.1, AI813344.1, AI767557.1, AI593529.1, AA888474.1, AA603364.1, AA601251.1, AM 50370.1, AA428312.1, AA305564.1, D78880.1, Z45190.1, AC063960.2, AC006447.17, AC011085.4, AC023285.2, AP001027.1, AL355358.1, AC025684.2, AC021877.4, AC011243.3, AL160291.2, AC006404.20, AC015424.1, AC019870.1, AC020079.1, AC007835.5, AC010565.3, AC010690.1, AC068007.1, AC062025.1, AC009578.3, AC023820.2, AC015567.3, AL109965.22, AL132671.19, AC069237.1, AC044882.2, AC068593.1, AC064847.1, AC023136.3, AC021555.3, AC026242.3, AC013685.3, AC016808.2, AC017040.3, AC013278.1, AP002000.1, AP001931.1,
SEQ ID NO. 205
NGO-Br-76
MK415/T3 5'

AB033888.1, NM_009236.1, I25032.1, AF047389.1, AF047043.1, AF017182.1, U66141.1, AJ001029.1, NM_000346.1, AF116571.1, NM_006941.1, NM_005686.1, AF149301.1, AC0074.61.8, AF006501.4, AF098915.1, AF083105.1, AF029696.1, AL031587.3, S74504.1, Z46629.1, AJ001183.1, I29086.1, U08223.2 NM_007084.1, NM_009238.1, NM_009233.1, NM_009234.1, NM_005986.1, AF107044.1, AF061784.1, AF009414.1, AL163672.1, AX001335.1, AX001334.1, U12533.1, AI004858.1, X96997.1, X70298.1, X94126.1, AB014474.1, D61688.1, M90534.1, D83649.1, AB012236.1, Y13436.1, AA764352.1, AW321606.1, AL043036.2, AL120408.1, AA172336.1, AW533152.1, AW532037.1, AW532030.1, AW529354.1, AW414006.1, AW251615.1, AW060475.1, AI884987.1, AI816765.1, AV116901.1, AI600115.1, AI594348.1, AI569726.1, AA965274.1, AI416080.1, AI406268.1, AI327463.1, M176078.1, AI137787.1, AA734962.1, AA616534.1, AA521730.1, AA040785.1, AW822773.1, AW506135.1, AW417535.1, AW046996.1, AW015864.1, AI566947.1, AI552551.1, AI359981.1, AL355803.2, AC024914.17, AL137061.2,
SEQ ID NO. 206
NGO-St-114 5' combined;

AC005618.1, X97999.1, NM_005642.1, U18062.1, Z65840.1, NM_011901.1, AF144562.1, Z65839.1, AC004540.1, AL137039.1, U20660.1, AE003630.1, U15947.1, AL132889.2, AL132885.1, AE003646.1, AE003605.1, AE003412.1, AF146393.1, AC004058.1, U32788.1, AC004056.1, AL355094.2, Au 31018.1, Z97180.1, AP001821.1, AC005825.3, AC006804.3, AE003778.1, AE003576.1, AE003510.1, AF136829.1, AF081203.1, AC004992.1, AF195610.1, AF195610.1, AC006961.16, AC006581.16, AC005414.2, U68299.1, AF016687.1, U23527.1, L78833.1, UI8349.1, AC004267.1, AF047659.1, U09744.1, AL117206.1, AL137080.2, Z81467.1, Z81028.1, Z82180.19, Z77652.2, Z75892.1, AL050305.9, Z77249.1, Z97629.1, AJ250862.1, U55366.1, X06535.1, U40028.1, AP001331.1, AP001111.1, AB029433.1, AB003324.1, D00170.1, Y17816.1, AU077198.1, AW673639.1, AA315968.1, AW029214.1, AA622246.1, D59188.1, AI904582.1, AW877796.1, AA595371.1, AA278660.1, AW877790.1, AA894917.1, AA252724.1, AA328618.1, AW402842.1, AW362899.1, H 14854.1, AW394189.1, AA312894.1, AW365030.1, I72766.1, AS582369.1, T65190.1, T52076.1, AW609538.1, AW366774.1, AA372836.1, AW380678.1, AA460590.1, F11914.1, AA383821.1, T47333.1, AA336307.1, AW403760.1, AA337398.1, AI951709.1, T34968.1, AA346865.1, AL119477.1, AW816164.1, AA348197.1, AA619797.1, T05543.1, AI158644.1, T83104.1, C03576.1, c03455.1, T86869.1, AV121343.1, AA572579.1, AA095559.1, AA517694.1,

TABLE 1-continued

Sequence homologies (GenBank Accession Numbers)

AA920998.1, AV205440.1, AA763469.1, AV212370.1, AI117791.1, AV213552.1, AV212700.1, C89279.1, H21207.1,
AV216550.1, AV100198.1, AV218081.1, AV214781.1, AV199703.1, AI722257.1, AA336858.1, AA102949.1,
AA182987.1, W26005.1, AW645787.1, AW638295.1, AW199696.1, R52386.1, AW563125.1, AW563124.1, AW506736.1,
AW506735.1, AW506714.1, AW506713.1, AW433456.1, AW330840.1, AW056105.1, AI987345.1, AW728753.1,
AI519245.1, AI511851.1, AI456317.1, AI455940.1, AA264246.1, AI756661.1, AI755675.1, AC008579.2, AC020971.1,
AC025193.1, AC021705.4, AC025256.4, AC068708.2, AC020898.3, AC020907.3, AC009035.5, AC026886.2,
AC021271.4, AC025944.3, AC025945.2, AC026220.2, AC007186.8, AC019704.1, AC015613.1, AC007913.1,
AL158151.5, AL157888.2, AL136135.2, AL133263.2, Z98857.36, AC026124.3, AC027751.2, AC026384.2, AC024050.6,
AC019207.3, AC020725.3, AC019835.1, AC014673.1, AC008189.2, AL109836.17, AP001894.1, AP001863.1,
AP001548.1, AP001544.1, AP001493.1, AP001282.1, AP000906.2,
SEQ ID NO. 207
NGO-St-114
YS071/T3 5'

NM_005642.1, AC005618.1, U18062.1, X97999.1, NM_011901.1, AF144562.1, Z65840.1, AE003630.1, U15947.1,
AL132889.2, AL132885.1, AFI4.6393.1, AC004055.1, AJ131018.1, AP001821.1, AE003778.1, AE003576.1, AC004992.1,
AC005414.2, AF016687.1, L78833.1, AC004267.1, AF047659.1, Z81028.1, U55366.1, U40028.1, AW029214.1,
AU077198.1, AW877796.1, AW877790.1, AA595371.1, AA252724.1, AA894917.1, AA622246.1, AA312894.1,
AA328618.1, AA460590.1, AW403760.1, T47333.1, AI904582.1, I72766.1, AA278660.1, AA372836.1, F11914.1,
T34968.1, T65190.1, AW673639.1, H14854.1, T05543.1, AA383821.1, AI158644.1, AA315968.1, AA572579.1,
AW402842.1, AA517694.1, AW362899.1, AW582369.1, AV121343.1, AA920998.1, AW516164.1, AW394189.1,
AV205440.1, C89279.1, AV213552.1, AV212370.1, AW609538.1, AV212700.1, AW365030.1, AA619797.1,
AW380678.1, C03576.1, AV216550.1, AV100198.1, AI722257.1, AA182987.1, AV218081.1, AV214781.1, AL119477.1,
D59188.1, AW645787.1, AW638295.1, AW199703.1, AW199696.1, AW728753.1, AI519245.1, AI511851.1, AI456317.1,
AI455940.1, AA264246.1, AI471179.1, AW375040.1, AW375037.1, AW021363.1, AI976597.1, AV049065.1, C54464.1,
C54153.1, C51985.1, AA426143.1, AA406093.1, C11684.1, R74232.1, D27736.1, AC008579.2, AC020971.1,
AC025193.1, AC020907.3, AC007186.8, AC019704.1, AL136135.2, AL133263.Z Z98857.36, AC026124.3, AP001863.1,
AC068193.4, AC036188.2, AC024947.2, AC025766.3, AC010623.3, AC016558.3, AC008534.3, AC036127.2,
AC068579.1, AC009142.4, AC011724.2, AC024698.4, AC022198.2, AC021719.3, AC022788.2, AC010764.3,
AC009695.4, AC025532.2, AC021157.3, AC016890.4, AC022273.2, AC016685.4, AC011266.3, AC023349.2,
AC018492.3, AC012101.3, AC024158.1, AC012448.3, AC010741.3, AC012387.4, AC017805.1, AC014787.1,
AC006937.5, AC006905.1, AL356435.1, AL109955.13, AL135939.9, AL133542.3, AL161790.3, AL162418.2,
AL159176.3, AP001993.1,
SEQ ID NO. 208
NGO-St-114
YS071/T7 3'

NM_005642.1, AC005618.1, U18062.1, X97999.1, NM_011901.1, AF144562.1, AL009178.4, AB016897.1, AL109801.13,
AE003618.1, AC007504.3, AC007172.6, AC005834.1, AB007651.1, AE003764.1, AE003738.1, AL078581.11,
AL031259.1, Z81455.2, Z82900.1, AB025604.1, Z30211.1, AC012082.6, AC004747.2, AC004521.2, AC024750.1,
AF233591.1, AC012099.4, AC003012.1, AC005076.2, AC007269.2, AF121898.1, AC006075.1, AC004583.1,
AF042091.1, AL163282.2, AL117191.4, AL121716.16, AL161585.2, AL121754.18, AL008723.8, AL021182.1,
AL031429.11, AL035593.11, AL023094.2, U37796.1, X04112.1, X15215.1, AI052691.1, AI346408.1, AW304965.1,
AI709369.1, AW190867.1, AW192823.1, AI818211.1, AI434577.1, AW264130.1, AA613880.1, AA507377.1,
AA417113.1, AI675129.1, AI371764.1, AI285611.1, AI125952.1, AW069225.1, AI376092.1, W65333.1, AI804531.1,
AI366201.1, AI940448.1, AW860175.1, AW604918.1, AA461518.1, AA063580.1, AA825152.1, AA604623.1,
AI278875.1, AA947107.1, AA417019.1, W39724.1, AI274749.1, W15503.1, AA776228.1, AW512466.1, W61316.1,
AI090392.1, AI356847.1, AW607519.1, AA975911.1, AA037065.1, AA838760.1, AW089083.1, AA635906.1,
AA824551.1, AA602587.1, AW265444.1, AA188912.1, T90567.1, AW519252.1, AW150510.1, R73733.1, AA508614.1,
W56065.1, T86870.1, AL118821.1, AA508722.1, AA886319.1, AA577447.1, AA380499.1, AA314905.1, AA854628.1,
AA412648.1, H84875.1, AW614384.1, F09561.1, AA326994.1, AA037079.1, AA380870.1, R30839.1, AI287373.1,
AI654286.1, R27607.1, T65121.1, H85281.1, N87733.1, AA715623.1, AA496962.1, AA460590.1, AA628285.1, C02002.1,
AA894943.1, AA876963.1, M431981.1, AA585211.1, AI216614.1, AA381394.1, AA278612.1, AA585402.1,
AW463162.1, D80075.1, R52386.1, AA036649.1, AA671025.1, AA369696.1, AW057744.1, T86869.1, AA794137.1,
AW414681.1, AC020971.1, AC025419.6, AC021297.2, AC020004.1, AC064829.3, AC009954.3, AC011791.3,
AC013328.5, AC007819.7, AC009807.3, AC016991.2, AC009345.6, AC008043.3, AC018408.1, AC0I7738.1,
AC018228.1, AL138817.5, AL356212.1, AL133518.3, AL136980.3, AL139294.1, AL031011.20, AP000708.1, Z82169.1,
Z95393.1,
SEQ ID NO. 209
NGO-St-114
YS081/T3 5'

AC005618.1, X97999.1, NM_005642.1, U18062.1, Z65840.1, Z65839.1, AC004540.1, AL137039.1, AE003630.1,
AL132889.2, AL132885.1, AE003646.1, AE003605.1, AE003412.1, AC004058.1, AC004056.1, Z97180.1, AP001821.1,
AC006804.3, AE003778.1, AE003576.1, AE003510.1, AF136829.1, AC006961.16, AC006581.16, AE001546.1,
U68299.1, U18349.1, AC004267.1, AF047659.1, U09744.1, Z77249.1, U55366.1, X06535.1, AP001111.1, AB029433.1,
Z95704.1, AB003324.1, D00170.1, Y17816.1, AU077198.1, AW673639.1, AA315968.1, D59188.1, T52076.1,
AA312894.1, AW366774.1, AA336307.1, AA337398.1, AI951709.1, AA460590.1, AL119477.1, AA348197.1, T86869.1,
AA095559.1, AW029214.1, AW877796.1, AW877790.1, AA595371.1, AA252724.1, AA894917.1, AW563125.1,
AW563124.1, AW506736.1, AW506735.1, AW506714.1, AW506713.1, AW433456.1, AW330840.1, AW056105.1,
AI987345.1, AI519245.1, AI511851.1, AI456317.1, AI455940.1, AA264246.1, AW649858.1, AW622907.1, AW217541.1,
AW217534.1, AI239260.1, C93674.1, AW787238.1, AW787237.1, AW597401.1, AW565183.1, AW352495.1,
AW331243.1, AW286148.1, AI668513.2, AW021363.1, AI976597.1, AI966918.1, AI966929.1, AI964567.1, AV155610.1,
AI756661.1, AI755675.1, AV049065.1, AI746131.1, AI711682.1, AI677124.1, AI667849.1, AI665080.1, AI63712:7.1,
AI549172.1, AI461446.1, AI461444.1, AA979929.1, AA979727.1, C72737.1, AA426143.1, AA406093.1, AA123407.1,
C19565.1, R74232.1, T18355.1, AC008579.2, AC021705.4, AC007186.8, AC019704.1, AC007913.1, AL158151.5,
Z98857.36, AC025179.3, AC008814.3, AC026384.2, AC024050.6, AC019207.3, AC020725.3, AC019835.1, AC014673.1,

TABLE 1-continued

Sequence homologies (GenBank Accession Numbers)

AC005189.2, AL109836.17, AL161444.2, AP001894.1, AP001863.1, AP001548.1, AP001544.1, AP001493.1,
AP001282.1, AP000906.2, AC068193.4, AC012386.9, AC006513.25, AC068979.2, AC036188.2, AC008533.5,
AC011367.5, AC011371.4, AC009142.4, AC025796.2, AC021409.3, AC010764.3, AC021373.3, AC011693.4,
AC016685.4, AC018862.3, AC019994.3, AC012109.2, AC010741.3, AC012726.1, AC017805.1, AC014787.1,
AC006937.5, AC006871.1, AC006803.2, AL354880.3, AL109955.13, AL139119.5, AL135939.9, AL355804.2,
AL354674.2, AL161790.3, AL159176.3, AL157770.2, AP001993.1, AP001806.1, AP001457.1, AP000881.1, AP000826.1,
AP000646.1, AP000621.1,
SEQ ID NO. 210
NGO-ST-114
YS081/T473'

NM_005642.1, AC005618.1, U18062.1, X979991, NM_011901.1, AF144562.1, AE003618.1, AC004927.2, AC007172.6,
AC005834.1, AE003738.1, AF165124.1, AL163258.2, AL078581.11, AL031259.1, AL109801.13, Z81455.2, L77246.1,
AP001713.1, AP000178.1, AP000033.1, AP000266.1, AP000102.1, Z99115.1, M15318.1, AC004747.2, AE002267.1,
AC004828.2, AE001658.1, AC004583.1, AF042091.1, AL355101.2, AL163282.2, AL109985.2, AL049569.13, U37796.1,
X76272.1, X04112.1, X15215.1, AB018107.1, AI434577.1, AI371764.1, AA947107.1, AW519252.1, AA776228.1,
AW512466.1, AW304965.1, AW264130.1, AI376092.1, AI274749.1, AI090392.1, AI052691.1, AA824551.1,
AA635906.1, AA604623.1, AA507377.1, AA417019.1, AA188912.1, AA063580.1, W61316.1, AI346408.1, AA825152.1,
AW069225.1, AA037065.1, AI675129.1, AI285611.1, AI278875.1, AI125952.1, AA975911.1, AA613880.1, AA602587.1,
AA461518.1, W15503.1, AW089083.1, AW190867.1, T90567.1, W56065.1, AW265444.1, AI356847.1, T86870.1,
AA838760.1, AI818211.1, AI366201.1, AA417113.1, AW192823.1, AI709369.1, AW150510.1, AA508614.1,
AA886319.1, AA577447.1, AW607519.1, AA380499.1, AA854628.1, H84875.1, AA508722.1, AW614384.1, F09561.1,
AI940448.1, AW860175.1, AW604918.1, W65333.1, W39724.1, AA314905.1, AA326994.1, AI804531.1, R73733.1,
AA412648.1, AI287373.1, AL118821.1, R27607.1, AA037079.1, T65121.1, AI654286.1, AA380870.1, N87733.1,
AA715623.1, AA946962.1, C02002.1, AA628285.1, H85281.1, AA460590.1, AA894943.1, AA876963.1, AA585211.1,
AI216614.1, R30839.1, AA278612.1, AA585402.1, D80075.1, AA036649.1, AW057744.1, AA794137.1, AA671025.1,
AI431981.1, AA381394.1, AA794920.1, AW463162.1, AI607308.1, AA691044.1, AW414681.1, AC020971.1,
AC025419.6, AC020004.1, AC064829.3, AC064826.2, AC034126.2, AC016547.5, AC008835.3, AC026466.3,
AC009954.3, AC024883.3, AC011791.3, AC016991.2, AC008043.3, AC018408.1, AC017738.1, AL133518.3,
AL133472.3, AL031011.20, Z95393.1, AC007834.20, AC007623.20, AC009757.7, AC021171.3, AC010644.5,
AC010590.4, AC008825.3, AC027749.2, AC024483.2, AC015533.4, AC027630.4, AC024466.3, AC018737.2,
AC024399.2, AC009554.4, AC026890.1, AC026021.1, AC016063.4, AC011781.4, AC016357.6, AC022518.2,
AC013478.3, AC015826.2, AL356212.1, AL137140.5, AL136359.4, AL161900.3, AL122125.1, AL139294.1, AP001872.1,
SEQ ID NO. 211
NGO-St-114
YS1615/T3 5'

X97999.1, AC005618.1, NM_005642.1, U18062.1, NM_011901.1, AF144562.1, U20660.1, U15947.1, AL132889.2,
AL132885.1, AF146393.1, AC004058.1, AJ131018.1, AP001821.1, AE003778.1, AC004992.1, AF195611.1,
AF195610.1, AC005414.2, AF016687.1, L78833.1, AC004267.1, AF047659.1, AL117206.1, Z81467.1, Z81028.1,
Z82180.19, Z77652.2, Z75892.1, AL050305.9, Z97629.1, U55366.1, U40028.1, AW029214.1, AA622246.1, AI904582.1,
AW877796.1, AA595371.1, AW877790.1 AA278660.1, AA894917.1, AA252724.1, AA328618.1, AW402842.1,
AW362899.1, H14854.1, I12766.1, AW394189.1, T65190.1, AW365030.1, AA372836.1, AW582369.1, F11914.1,
AU077198.1, AW609538.1, AW380678.1, AA383821.1, T47333.1, AW403760.1, T34968.1, AA460590.1, AA312894.1,
AW816164.1, AA346865.1, AA619797.1, T05543.1, AI158644.1, AV121343.1, AA572579.1, C03576.1, AA517694.1,
T83104.1, C03455.1, AA920998.1, AV205440.1, AV212370.1, AV213552.1, AV212700.1, C89279.1, AA763469.1,
H21207.1, AV216550.1, AI117791.1, AV100198.1, AV218081.1, AV214781.1, AW199703.1, AI722257.1, AJ182987.1,
AA336858.1, AW645787.1, AW638295.1, AW199696.1, AW728753.1, AA102949.1, AI471179.1, AW375040.1,
AW375037.1, AV049065.1, C54464.1, C54153.1, C51985.1, C49917.1, C11684.1, D27736.1, AC008579.2, AC020971.1,
AC025193.1, AC025256.4, AC020898.3, AC020907.3, AC009035.5, AC015613.1, AL136135.2, AL133263.2, Z98857.36,
AC026124.3, AC027751.2, AP001863.1, AC068193.4, AC036188.2, AC024947.2, AC025972.2, AC041033.2,
AC026404.4, AC025766.3, AC024583.3, AC010243.3, AC010273.3, AC010302.3, AC010623.3, AC016558.3,
AC008534.3, AC036127.2, AC068579.1, AC009171.4, AC009142.4, AC013670.3, AC017106.3, AC018686.4,
AC011724.2, AC024698.4, AC022198.2, AC021719.3, AC019033.4, AC022788.2, AC023629.2, AC010764.3,
AC021828.2, AC009695.4, AC025532.2, AC021157.3, AC016890.4, AC022273.2, AC016685.4, AC011266.3,
AC023349.2, AC018492.3, AC012101.3, AC024158.1, AC012387.4, AC017805.1,
AC014787.1, AC006937.5, AC006905.1, AC006704.1, AL356435.1, AL355593.3, AL133542.3, AL161790.3,
AL162418.2, AL159176.3, Z92842.1, Z92863.2, AP001993.1,
SEQ ID NO. 212
NGO-ST-114
YS1615/T7 3'

AC005618.1, NM_005642.1, U18062.1, X97999.1, NM_011901.1, AF144562.1, AL009178.4, AB016897.1, AE003618.1,
AC007504.3, AB007651.1, AE003764.1, AE003738.1, AF165124.1, AL078581.1, AL031259.1, Z81455.2, Z82900.1,
L77246.1, AB025604.1, Z99115.1, M15318.1, Z30211.1, AC012082.6, AC004521.2, AC024750.1, AE003600.1,
AF233591.1, AE001658.1, AF121898.1, AF022814.1, AF042091.1, AF005383.1, AL117191.4, AL121716.16,
AC002077.1, AL021182.1, AL031429.11, X76272.1, X04112.1, X15215.1, AI052691.1, AI346408.1, AW304965.1,
AW190867.1, AI709369.1, AW192823.1, AI818211.1, AI434577.1, AW264130.1, AA507377.1, AA613880.1,
AA417113.1, AI675129.1, AI371764.1, AI285611.1, AI125952.1, AI376092.1, AW069225.1, AI366201.1, AI804531.1,
AA063580.1, AA461518.1, W65333.1, AA825152.1, AA604623.1, AA947107.1, AI278875.1, AA417019.1, AI274749.1,
W15503.1, AA776228.1, AW512466.1, W61316.1, AI090392.1, AI940448.1, W39724.1, AI356847.1, AW860175.1,
AW604918.1, AA975911.1, AA037065.1, AA838760.1, AA635906.1, AW089083.1, AA824551.1, AA602587.1,
AW265444.1, AA188912.1, AW519252.1, T90567.1, AW150510.1, AA508614.1, W56065.1, AW607519.1, T86870.1,
R73733.1, AL118821.1, AA886319.1, AA508722.1, AA577447.1, AA380499.1, AA854628.1, H84875.1, AW614384.1,
F09561.1, AI287373.1, AA314905.1, AA326994.1, R30839.1, R27607.1; T65121.1, AA412648.1, AI654286.1, N87733.1,
AA715623.1, AA037079.1, AA946962.1, AA380870.1, C02002.1, AA628285.1, AA894943.1, AA876963.1, AI431981.1,
AA460590.1, I185281.1, AA585211.1, AI216614.1, AA278612.1, AA585402.1, D80075.1, AW057744.1, AA381394.1,

TABLE 1-continued

Sequence homologies (GenBank Accession Numbers)

AA036649.1, AA794137.1, AA691044.1, AA671025.1, AA794920.1, AW414681.1, AW463162.1, AA549454.1,
AC020971.1, AC025419.6, AC064829.3, AC064,826.2, AC008835.3, AC013328.5, AC009807.3, AC018408.1,
AC017738.1, AC018228.1, AL138817.5, AL133472.3, AL136980.3, Z82169.1, AC009757.7, AC060773.2, AC036223.2,
AC008825.3, AC027438.2, AC015679.3, AC015964.2, AC021450.3, AC011218.4, AC022625.1, AC006719.1,
AL163153.1,
SEQ ID NO. 213
NGO-St-114
YS1631/T7 3'

NM_005642.1, AC005618.1, U18062.1, X97999.1, NM_011901.1, AF144562.1, AL009178.4, AB016897.1, AE003618.1,
AC007504.3, AB007651.1, AE003738.1, AF165124.1, AL078581.11, AL031259.1, AL109801.13, Z81455.2, Z82900.1,
L77246.1, AB025604.1, Z99115.1, M15318.1, Z30211.1, AC012082.6, AC004521.2, AC024750.1, AC012099.4,
AL121716.16, AL021182.3, AP001037.1, AI052691.1, AW304965.1, AI709369.1, AI346408.1, AW190867.1,
AW192823.1, AI818211.1, AI434577.1, AW264130.1, AA507377.1, AA613880.1, AI417113.1, AI675129.1, AI371764.1,
AI285611.1, AI125952.1, AI376092.1, AW069225.1, AI366201.1, AI804531.1, AA461518.1, AA063580.1, W65333.1,
AA825152.1, AA604623.1, AA947107.1, AI278875.1, AA417019.1, AI274749.1, W15503.1, AA776228.1, AW512466.1,
W61316.1, AI090392.1, AI356847.1, W39724.1, AA975911.1, AA037065.1, AI940448.1, AW860175.1, AW604918.1,
AA838760.1, AW089083.1, AA635906.1, AA824551.1, AA602587.1, AW265444.1, AA188912.1, AW519252.1,
T90567.1, AW150510.1, AA508614.1, W56065.1, T86870.1, AL118821.1, R73733.1, AA508722.1, AA886319.1,
AW607519.1, AA577447.1, AA380499.1, AA854628.1, H84875.1, AW614384.1, F09561.3, AI287373.1, R30839.1,
AA326994.1, R27607.1, T65121.1, AA314905.1, AI654286.1, N87733.1, AA412648.1, AA715623.1, AA946962.1,
AA628285.1, C02002.1, AA037079.1, AA380870.1, AA894943.1, AA876963.1, AI431981.1, AA585211.1, AI216614.1,
AA460590.1, H85281.1, AA278612.1, AA585402.1, D80075.1, AW057744.1, AA794137.1, AA691044.1, AA671025.1,
AA794920.1, AW414681.1, AA381394.1, AA036649.1, AI859319.1, AW463162.1, AC020971.1, AC025419.6,
AC064829.3, AC064826.2, AC034126.2, AC008835.3, AC013328.5, A0009807.3, AC018228.1, AL133472.3,
AL136980.3, AC023599.7, AC068540.2, AC009757.7, AC060773.2, AC036223.2, AC008825.3, AC026083.3,
AC027438.2, AC015679.3, AC015964.2, AC011218.4, AC024065.2, AC011647.3, AC013478.3, AC006719.1,
AL135842.4,
SEQ ID NO. 214
NGO-St-114
YS1682/T3 5'

AC005618.1, X97999.1, NM_005642.1, U18062.1, Z65840.1, Z65839.1, AC004540.1, AL137039.1, AE003630.1,
AE003646.1, AE003605.1, AB003412.1, AC004058.1, AC004056.1, AL132889.2, Z97180.1, AL132885.1, AP001821.1,
AC004005.2, AC006804.3, AE003778.1, AE003510.1, AF136829.1, AC006961.16, AC006581.16, U68299.1, U18349.1,
AF047659.1, U09744.1, Z77249.1, U55366.1, X06535.1, AP001113.1, AB029433.1, AB003324.1, D00170.1, Y17816.1,
AU077198.1, AW673639.1, AA315968.1, D59188.1, T52076.1, AW366774.1, AA336307.1, AA337398.1, AA312894.1,
AI951709.1, AL119477.1, AA348197.1, AA460590.1, T86869.1, AA095559.1, AW029214.1, AA252724.1, AW877796.1,
AW877790.1, AW563125.1, AW563124.1, AW506736.1, AW506735.1, AW506714.1, AW506713.1, AW433456.1,
AW330840.1, AW056105.1, AI987345.1, AI519245.1, M511851.1, AI456317.3, AI455940.1, AA264246.1, AW649858.1,
AI239260.1, C93674.1, AW787238.1, AW787237.1, AW597401.1, AW565183.3, AW352495.1, AW331243.1,
AW286 348.1, AI668513.2, AW021363.1, AI976597.1, AI966918.1, AI966929.1, AI964567.1, AI857189.1, AI756661.1,
AI755675.1, AV049065.1, AI746131.1, AI711682.1, AI677124.1, AI667849.1, AI665080.1, AI637127.1, AI549172.1,
AI461446.1, AI461444.1, AA979929.1, AA979727.1, C72737.1, AA426143.1, AA406093.1, C19565.1, R74232.1,
T18355.1, AC008579.2, AC021705.4, AC007186.8, AC019704.1, AC007913.1, AL158151.5, AC068193.4, AC026384.2,
AC024050.6, AC019207.3, AC020725.3, AC019835.1, AC014673.1, AC005189.2, AL109836.17, AL159176.3,
Z98857.36, AP001894.1, AP001863.1, AP001548.1, AP001544.1, AP001493.1, AP001282.1, AP000906.2, AC012386.9,
AC006513.25, AC068979.2, AC036188.2, AC009142.4, AC025796.2, AC021409.3, AC021373.3, AC016685.4,
AC012109.2, AC012726.3, AC0I4787.1, AC006871.1, AC006803.2, AL354880.3, AL109955.13, AL135939.9,
AL355472.2, AL355804.2, AL354674.2, AL157770.2, AP001993.1, AP001806.1, AP000881.1, AP000826.1, AP000646.1,
AP000621.1,
SEQ ID NO. 215
NGO-St-134
YS1743/T3 5'

AC005618.1, X97999.1, NM_005642.1, U18062.1, Z65840.1, Z65839.1, AC004540.1, AL137039.1, AE003630.1,
AC000003.1, AE003646.1, AE003605.1, AE003412.1, AC004254.1, AC004056.1, AL035448.28, Z97180.1, AC006804.3,
AE003758.1, AE003634.1, AE003597.1, AE003510.1, AC007029.3, AF136829.1, AC000064.1, AC002458.1,
NM_004703.1, AC006961.16, AC006581.16, AC007566.1, AC006240.1, U68299.1, AC004148.1, AC005547.1, UI8349.3,
U73644.1, U09744.1, AL132889.2, Z77249.1, AL132885.1, X06535.1, X77723.1, X91141.1, AP001111.1, AB029433.1,
AB003324.1, D00170.1, Y17816.1, AU077198.1, AW673639.1, AA315968.1, D59188.1, T52076.1, AW366774.1,
AA336307.1, AA337398.1, AI951709.1, AA312894.1, AL119477.1, AA348197.1, AA460590.1, T86869.1, AA095559.1,
AW563125.1, AW563124.3, AW506736.1, AW506735.1, AW506714.1, AW506713.1, AW433456.1, AW330840.1,
AW056105.1, AI987345.1, AI976597.1, AI519245.1, AI511851.1, AI456317.1, AI455940.1, AA264246.1, AW649858.1,
AI239260.1, C93674.1, AW787238.1, AW787237.1, AW728753.1, AW597401.1, AW565183.1, AW374004.1,
AW352495.1, AW331243.1, AW286148.1, AI668513.2, AL120839.1, AW021363.1, AI966918.1, AI966929.1,
AI964567.1, AI912789.1, AI857189.1, AI756661.1, AI755675.1, AV049065.1, M746131.1, AII11682.3, AI677124.1,
AI667849.1, AI665080.1, AI637127.1, AI549172.1, AI461446.1, AI461444.1, AI372843.1, AA979729.1, AA979727.1,
C72737.1, AA551099.1, AA426143.1, AA406093.1, AA203657.1, C19565.1, R74232.1, F06378.1, T18355.1,
AC008579.2, AC021705.4, AC015898.4, AC026989.2, AC020553.3, AC015900.2, AC011789.4, AC022373.1,
AC007186.8, AC019704.1, AC007913.1, AL158151.5, AL157785.2, AL355332.1, AC026728.3, AC026712.3,
AC026384.2, AC024050.6, AC019207.3, AC020725.3, AC023953.2, AC009593.4, AC019835.1, AC014673.1,
AC008189.2, AC008159.1, AL109836.17, AP001894.1, AP001548.1, AP001544.1, AP001493.1, AP001282.1,
AP000906.2, AC012386.9, AC006513.25, AC068979.2, AC063921.4, AC055875.2, AC034211.3, AC008066.3,
AC020740.4, AC025942.2, AC025796.2, AC021409.3, AC022788.2, AC025525.2, AC025532.2, AC021373.3,
AC022247.2, AC017029.4, AC016685.4, AC011566.3, AC012109.2, AC015727.3, AC010741.3, AC009981.5,
AC019821.1, AC007984.3, AC012726.1, AF212833.1, AC017607.1, AC014838.1, AC009366.6, AC006871.1,

TABLE 1-continued

Sequence homologies (GenBank Accession Numbers)

AC006803.2, AL354880.3, AL109955.13, AL135939.9, AL355804.2, AL354674.2, AL161790.3, AL157770.2, Z98857.36,
AP001993.1, AP001806.1, AP000881.1, AP000841.1, AP000826.1, AP000646.1, AP000621.1,
SEQ ID NO. 216
NGO-St-114
YS1751/T7 3'

NM_005642.1, AC005618.1, U18062.1, X97999.1, NM_011901.1, AF144562.1, AL121748.6, AL031259.1, Z81455.2,
AL009178.4, AB016897.1, AC010227.5, AC008893.4, AC008000.7, AC007172.6, AC004583.1, AF042091.1,
AL355094.2, AL163282.2, AL031683.1, X15215.1, AB005246.1, AB005230.1, AW304965.1, AI052691.1, AW190867.1,
AI709369.1, AW192823.1, AI346408.1, M818211.1, AI434577.1, AW264130.1, AA613880.1, AA507377.1, AA417113.1,
AI804531.1, AI371764.1, AI285611.1, AI675129.1, AI125952.1, AW069225.1, AI376092.1, AI366201.1, AA947107.1,
AA461518.1, AA063580.1, AA825152.1, AA776228.1, AA604623.1, AI278875.1, AI274749.1, AA417019.1, W65333.1,
W15503.1, AW512466.1, W61316.1, AI090392.1, AI356847.1, AA975911.1, W39724.1, AA037065.1, AW265444.1,
AW089083.1, AA838760.1, AA635906.1, AA824551.1, AA602587.1, AI940448.1, AA188912.1, AW519252.1,
AW860175.1, AW604918.1, T90567.1, AW1505101, W56065.1, T86870.1, AA508614.1, AL118821.1, R73733.1,
AA508722.1, AA886319.1, AA577447.1, AA380499.1, AA854628.1, AW614384.1, AW607519.1, H84875.1, F09561.1,
AI654286.1, AI287373.1, R30839.1, AA326994.1, T65121.1, R27607.1, AA314905.1, AA946962.1, N87733.1,
AA715623.1, AA412648.1, AA628285.1, C02002.1, AA037079.1, AA894943.1, AA876963.1, AI431981.1, AA380870.1,
AI216614.1, AA585211.1, AA278612.1, AA585402.1, AA460590.1, H85281.1, AW057744.1, D80075.1, AA794137.1,
AA691044.1, AA671025.1, AA794920.1, AW414681.1, AC025419.6, AC015533.4, AC009954.3, AC016357.6,
AC021952.4, AL133518.3, AL353600.1, AL031011.20, Z95393.1, AC012600.4, AC012515.11, AC007834.20,
AC007623.20, AC021171.3, AC026459.2, AC008952.4, AC010626.4, AC068206.1, AC027630.4, AC044795.2,
AC024399.2, AC012600.3, AC016275.2, AC015826.2, AC009615.2, AC004555.2, AL356212.1, AL137140.5,
AL136980.3, AL161900.3, AL139294.1,
SEQ ID NO. 217
NGO-St-114
YS1771/T3 5'

AC005618.1, X97999.1, NM_005642.1, UI8062.1, Z65840.1, Z65839.1, AC004540.1, AL137039.1, AE003630.1,
AL132889.2, AL132885.1, AE003646.1, AE003605.1, AE003412.1, AC004058.1, AC004056.1, Z97180.1, AP001821.1,
AC006804.3, AE003510.1, AF136829.1, AC006961.16, U68299.1, U18349.1, U09744.1, Z77249.1,
X06535.1, AP001111.1, AB029433.1, AB003324.1, D00170.1, Y17816.1, AU077198.1, AW673639.1, AA315968.1,
D59188.1, T52076.1, AA312894.1, AW366774.1, AA336307.1, AA337398.1, AA460590.1, AI951709.1, AL119477.1,
AA348197.1, T86869.1, AA095559.1, AW029214.1, AW877796.1, AW877790.1, AA595371.1, AA252724.1,
AA894917.1, AW563125.1, AW563124.1, AW506736.1, AW563714.1, AW506713.1, AW433456.1;
AW330840.1, AW056105.1, AI987345.1, M519245.1, AI511851.1, AI456317.1, AI455940.1, AA264246.1, AW649858.1,
AI239260.1, C93674.1, AW787238.1, AW787237.1, AW597401.1, AW565183.1, AW352495.1, AW331243.1,
AW286148.1, AI668513.2, AW021363.1, M976597.1, AI966918.1, AI966929.1, AI964567.1, AI756661.1, M755675.1,
AV049065.1, AI746131.1, AI711682.1, AI677124.1, AI667849.1, AI665080.1, AI637127.1, AI549172.1, AI461446.1,
AI461444.1, AA979929.1, AA979727.1, C72737.1, AA426143.1, AA406093.1, C19565.1, R74232.1, T18355.1,
AC008579.2, AC021705.4, AC007186.8, AC019704.1, AC007913.1, AL158151.5, Z98857.36, AC026384.2, AC024050.6,
AC019207.3, AC020725.3, AC019835.1, AC014673.1, AC008189.2, AL109836.17, AP001894.1, AP001863.1,
AP001548.1, AP001544.1, AP001493.1, AP001282.1, AP000906.2, AC012386.9, AC006513.25, AC068979.2,
AC009142.4, AC022198.2, AC025796.2, AC021719.3, AC021409.3, AC022788.2, AC021782.2, AC025321.2,
AC010929.2, AC025532.2, AC021373.3, AC016685.4, AC012109.2, AC018879.3, AC010741.3, AC012726.1,
AC006871.1, AC006803.2, AL354880.3, AL109955.13, AL135939.9, AL355804.2, AL354674.2, AL161790.3,
AL157770.2, AP001993.1, AP001806.1, AP000881.1, AP000826.1, AP000646.1, AP000621.1,
SEQ ID NO. 218
NGO-St-114
YS181/T3 5'

AC005618.1, X97999.1, NM_005642.1, U18062.1, Z65839.1, Z65840.1, AC006804.3, AE003512.1, AC002052.8,
AC006961.16, AW673639.1, D59188.1, AA315968.1, AUG77198.1, T52076.1, AW366774.1, AA348197.1, AA337398.1,
AA336307.1, AI951709.1, T86869.1, AA095559.1, AL119477.1, AA312894.1, AI239260.1, AA516747.1, AC008579.2,
AC007913.1, AL158151.5, AC017003.2, AC012386.9, AC068979.2, AC026101.6, AC016639.5, AC016632.4,
AC034249.1, AC021373.3, AC017624.1, AC010671.7, AC006871.1, AC006803.2, AP001806.1, AP000881.1,
AP000826.1, AP000646.1,
SEQ ID NO. 219
NGO-St-114
YS191/T7 3'

AC005618.1, NM_005642.1, UI8062.1, X979991, NM_011901.1, AF144562.1, AL009178.4, AB016897.1, AE003618.1,
AC007504.3, AB007651.1, AE003764.1, AE003738.1, AF165124.1, AL163258.2, AL078581.11, AL031259.1, Z81455.2,
Z82900.1, L77246.1, AP001713.1, AP000178.1, AP000033.1, AB025604.1, AP000102.1, AP000102.1, Z99115.1,
M15318.1, Z30211.1, AC012082.6, AC004521.2, AC024750.1, AL121716.16, AL109801.13, AL008723.8, AL021182.1,
AB018107.1, AB005246.1, AI052691.1, AI346408.1, AW304965.1, AW190867.1, AI709369.1, AW192823.1, AI434577.1,
AI818211.1, AW264130.1, AA613880.1, AA507377.1, AA417113.1, AI675129.1, AI371764.1, AI285611.1, AI125952.1,
W65333.1, AI376092.1, AW069225.1, AI366201.1, AI804531.1, AA461518.1, AA063580.1, AA825152.1, AA604623.1,
AW860175.1, AW604918.1, AI940448.1, AI278875.1, AA947107.1, W39724.1, AA417019.1, AI274749.1, W15503.1,
AA776228.1, AW512466.1, W61316.1, AI090392.1, AI356847.1, AA975911.1, AA037065.1, AA838760.1, AW089083.1,
AW607519.1, AA635906.1, AA824551.1, AA602587.1, AW265444.1, AA188912.1, AW519252.1, T90567.1,
AW1505101, R73733.1, AA508614.1, W56065.1, T86870.1, AL118821.1, AA508722.1, AA886319.1, AA577447.1,
AA380499.1, AA854628.1, I84875.1, AA314905.1, AW614384.1, F09561.1, AA326994.1, AA412648.1, AI287373.1,
R30839.1, AA037079.1, R27607.1, AA380870.1, T65121.1, AI654286.1, N87733.1, AA715623.1, AA946962.1, H85281.1,
AA460590.1, AA628285.1, C02002.1, AA894943.1, AA876963.1, AI431981.1, AA585211.1, AI216614.1, AA278612.1,
AA585402.1, AA671025.1, D80075.1, AW463162.1, AA381394.1, AA036649.1, AA794137.1, AW057744.1, R52386.1,
AA794920.1, AA549454.1, AV100160.1, AC020971.1, AC025419.6, AC064829.3, AC064826.2, AC008835.3,

TABLE 1-continued

Sequence homologies (GenBank Accession Numbers)

AC013328.5, AC009807.3, AC017738.1, AC018228.1, AL133472.3, AL136980.3, AL353600.1, Z82169.1, AC009757.7, AC060773.2, AC036223.2, AC008825.3, AC027438.2, AC015679.3, AC013782.3, AC016693.4, AC024065.2, AC011647.3, AC013478.3, AC006719.1,
SEQ ID NO. 220
NGO-St- 114
YS274/F7 3'

NM_005642.1, AC005618.1, U18062.1, X97999.1, NM_011901.1, AF144562.1, AE003618.1, AC007172.6, AC005834.1, AE003738.1, AF165124.1, AL163258.2, AL078581.11, AL031259.1, Z81455.2, AP001713.1, AP000178.1, AP000033.1, AP000266.1, AP000102.1, AC004747.2, AC004583.1, AF042091.1, AL163282.2, AL163277.2, AL132879.2, X76272.1, X04112.1, AP001732.1, X15215.1, AP001037.1, AB018107.1, AI434577.1, AI371764.1, AA947107.1, AW519252.1, AA776228.1, AW512466.1, AW304965.1, AW264130.1, AI376092.1, AI274749.1, AI090392.1, AI052691.1, AA824551.1, AA635906.1, AA604623.1, AA507377.1, AA417019.1, AA188912.1, AA063580.1, W61316.1, AW069225.1, AI346408.1, AA825152.1, AI675129.1, AI278875.1, AI125952.1, AA975911.1, AA613880.1, AA602587.1, AA461518.1, AA037065.1, AI285611.1, AW089083.1, AW190867.1, W15503.1, T90567.1, W56065.1, AW265444.1, AI356847.1, T86870.1, AI366201.1, AA838760.1, AA417113.1, M818211.1, AW192823.1, AI709369.1, AW607519.1, AW150510.1, AA508614.1, AA886319.1, AA577447.1, AA380499.1, AA854628.1, AW860175.1, AW604918.1, K84875.1, AA508722.1, AW614384.1, AI940448.1, AA412648.1, F09561.1, AA314905.1, W39724.1, W65333.1,. AA326994.1, AI804531.1, R73733.1, AA037079.1, AI287373.1, AL118821.1, AA380870.1, R27607.1, T65121.1, AI654286.1, N87733.1, AA715623.1, AA946962.1, H85281.1, AA628285.1, C02002.1, AA460590.1, AA894943.1, AA876963.1, AA585211.1, AI216614.1, R30839.1, AA278612.1, AA585402.1, AA381394.1, AW463162.1, D80075.1, AA671025.1, AA794137.1, AA036649.1, AW057744.1, AI431981.1, R52386.1, AA794920.1, AA369696.1, AA549454.1, AC020971.1, AC025419.6, AC020004.1, AC064829.3, AC016547.5, AC008835.3, AC009954.3, AC011791.3, AC016991.2, AC008043.3, AC018408.1, AC017738.1, AL133518.3, AL031011.20, Z95393.1, AC007834.20, AC007623.20, AC067724.3, AC009757.7, AC021171.3, AC064826.2, AC027235.2, AC010515.5, AC008825.3, AC027749.2, AC024483.2, AC015533.4, AC027630.4, AC025229.3, AC046169.1, AC044876.1, AC018737.2, AC024399.2, AC026890.1, AC022020.3, AC024424.2, AC016063.4, AC019157.4, AC011781.4, AC016357.6, AC022.518.2, AC013478.3, AC015826.2, AL356212.1, AL355305.2, AL139258.3, AL137140.5, AL161900.3, AL122125.1, AL139294.1, AL022594.18, AP001872.1,
SEQ ID NO. 221
NGO-St-114
YS303/T7 3'

NM_005642.1, AC005618.1, U18062.1, X97999.1, NM_011901.1, AF144562.1, AC007172.6, AL121748.6, Z81455.2, Z82900.1, AC004521.2, AC012099.4, AC004583.1, AF042091.1, AL163282.2, Z92812.1, X15215.1, AI052691.1, AW304965.1, AI709369.1, AW190867.1, AI346408.1, AW192823.1, AI818211.1, AW264130.1, AA613880.1, AA507377.1, AI434577.1, AI675129.1, AA417113.1, AI371764.1, AI285611.1, AI125952.1, AI804531.1, AW069225.1, AI376092.1, AI366201.1, AA461518.1, AA825152.1, AA604623.1, AI278875.1, AA947107.1, AA063580.1, AI274749.1, AA776228.1, AA417019.1, W15503.1, W65333.1, AW512466.1, AI356847.1, W61316.1, AI090392.1, AA975911.1, AA037065.1, W39724.1, AW089083.1, AA635906.1, AA838760.1, AW265444.1, AA824551.1, AA602587.1, AI940448.1, AA188912.1, AW860175.1, AW604918.1, AW519252.1, T90567.1, AW15O510.1, AA508614.1, W56065.1, T86870.1, AL118821.1, AA508722.1, AA886319.1, AA577447.1, R73733.1, AA380499.1, AA854628.1, AW614384.1, AW607519.1, H84875.1, F09561.1, AI654286.1, AI287373.1, R30839.1, AA325994.1, AA314905.1, R27607.1, T65121.1, AA326994.1, AA715623.1, N87733.1, AA412648.1, AA628285.1, 032002.1, AA894943.1, AA876963.1, AI431981.1, AA380870.1, AA037079.1, AI216614.1, AA585211.1, I185281.1, AA460590.1, AA278612.1, AA585402.1, AW057744.1, D80075.1, AW414681.1, AA794137.1, AA671025.1, AA691044.1, AA794920.1, AA036649.1, AW280434.1, AI162830.1, AC020971.1, AC015533.4, AC016357.6, AL138817.5, AL133518.3, AL353600.1, AL031011.20, Z82169.1, Z95393.1,
SEQ ID NO. 222
NGO-St-114
YS305/T7 3'

NM_005642.1, AC005618.1, U18062.1, X97999.1, Z81455.2, AL078462.9, AL034349.3, X15215.1, AI052691.1, AW304965.1, AI709369.1, AW190867.1, AI818211.1, AI346408.1, AW192823.1, AI804531.1, AI434577.1, AW264130.1, AA613880.1, AA507377.1, AA417113.1, AI675129.1, AI371764.1, M125952.1, AI285611.1, AW069225.1, AI376092.1, AI366201.1, AA461518.1, W65333.1, AA825152.1, AA604623.1, AI278875.1, AA947107.1, AA417019.1, AI274749.1, AA776228.1, AA063580.1, W15503.1, AW512466.1, AI090392.1, W61316.1, W39724.1, AI356847.1, AA975911.1, AW089083.1, AI940448.1, AA635906.1, AA037065.1, AW265444.1, AA824551.1, AA602587.1, AA838760.1, AW519252.1, AA188912.1, W56065.1, T86870.1, AW860175.1, AW604918.1, T90567.1, AA886319.1, AA577447.1, AW150510.1, AA854628.1, AA508614.1, R73733.1, AW614384.1, AA380499.1, P09561.1, AW607519.1, AA508722.1, AI654286.1, AL118821.1, H84875.1, AA326994.1, AI287373.1, AA946962.1, AA314905.1, T65121.1, R27607.1, AA412648.1, AA628285.1, C02002.1, R30839.1, N87733.1, AA715623.1, AI216614.1, AA894943.1, AA876963.1, AA380870.1, AA037079.1, AA58521.11, AA278612.1, AA585402.1, AA460590.1, H85281.1, AW057744.1, AI431981.1, D80075.1, AA036649.1, AL031011.20, Z95393.1, AC018923.5, AC036181.2, AC068931.1, AC009440.2, AC027630.4, AC009554.4, AC006286.13, AC011996.3, AC010890.3, AC009528.7, AC007913.1, AL158151.5, AL161785.4,
SEQ ID NO. 223
NGO-St-115
YS1641/T7 3'

L34543.1, L07872.1, L34544.1, NM_015874.1, L08904.1, D14041.1, S63463.1, X17459.1, M81871.1, U60093.1, U60094.1, M81877.1, M81876.1, AE003830.1, AC006578.5, AC005974.1, AC002416.1, ALOZI 578.1, AB024964.1, AB026048.1, AC012397.31, AC012147.7, AC009396.5, AC007270.2, AC007314.3, AF049850.1, AF016494.1, AL032655.1, U23177.1, D25323.1, D90170.1, D90168.1, M64933.1, AI627646.1, AA641661.1, AI401150.1, AW090508.1, AA701607.1, AI962712.1, AI953614.1, AW131544.1, AW302357.1, AA042864.1, AA640106.1, AI984992.1, AA903408.1, AA483607.1, AA501219.1, AA069672.1, AW249681.1, AW235086.1, AI381502.1, AI619912.1, AI291840.1, AI023923.1, T67414.1, AI580826.1, AI375729.1, AI565611.1, AI334962.1, AI334964.1, AI669755.1, N95392.1, AW425207.1, AW815621.1, AW005947.1, AI982567.1, AI144435.1, AA171398.1, AA788576.1, P33435.1, AI631440.1, AA669918.1, AW815443.1, AW391454.1, AA101255.1, AA676341.1, AW815833.1,

TABLE 1-continued

Sequence homologies (GenBank Accession Numbers)

AA169326.1, AW815622.1, AW391447.1, AW815635.1, U69195.1, AA101351.1, AA908462.1, AA126685.1,
AW815508.1, AW815506.1, AW249892.1, AW815512.1, AW609613.1, AA044415.1, AA678797.1, AW381515.1,
AW474060.1, AW801962.1, AW381537.1, R12509.1, AA156824.1, AW379059.1, AW371260.1, AI720441.1,
AW189578.1, T23713.1, AW371378.1, AW381482.1, AW381510.1, AW381496.1, AA705248.1, R193141.1, T70135.1,
AW462450.1, AW381476.1, P05151.1, AI206928.1, AW381459.1, AW843169.1, AW610177.1, AW393428.1,
AW016196.1, AW009270.1, AA092442.1, AW371229.1, AI658933.1, AI919572.1, AW384329.1, AI708578.1,
AI435870.1, AI274998.1, AA969666.1, AA235124.1, W25228.1, AC006391.7, AC016175.1, AL356136.1, AC009423.2,
AC017078.3, AC027239.2, AC024155.2, AC021304.2, AL354733.4, AL135938.7, AL353743.1, AP001998.1,
AC022816.9, AC021256.4, AC024322.2, AC017144.1, AL162420.3, AC009192.60, AC068789.3, AC051628.10,
AC018995.4, AC012480.4, AC035149.2, AC016591.4, AC040893.1, AC023199.2, AC026808.1, AC022926.2,
AC015797.2, AC013664.1, AL356260.1, AL118513.14, AL354999.1, AL160035.3, AL159978.2, AL022597.5,
AP001532.1, AP001400.1, AP000590.3, Z92865.1, AL022596.1,
SEQ ID NO. 224
NGO-St-115
YS1693/T7 3'

L34543.1, L07872.1, L34544.1, NM_015874.1, L08904.1, D14041.1, 563463.1, X17459.1, M81871.1, U60093.1,
U60094.1, M81877.1, M81876.1, AE003830.1, AC005974.1, AL021578.1, AB024964.1, AB026048.1, AC012397.31,
AC012147.7, AC007270.2, AF049550.1, AF016494.1, X56462.1, D25323.1, D90170.1, D90168.1, M64933.1, X59856.1,
AA641661.1, AI627646.1, AI962712.1, AA701607.1, AW090508.1, AI401150.1, AW131544.1, AI953614.1, AI829826.1,
AW302357.1, AA042864.1, AA640106.1, AI984992.1, AA903408.1, AA483607.1, AA069672.1, AW249681.1,
AW235086.1, AI381502.1, AI619912.1, AI291840.1, M023923.1, AA501219.1, T67414.1, AI580826.1, AI375729.1,
AI565611.1, AI334962.1, AI334964.1, AI669755.1, N95392.1, AW815621.1, AW005947.1, AI982567.1, AI144435.1,
AA171398.1, AA788576.1, AW425207.1, P33435.1, AI631440.1, AA669918.1, AW815443.1, AW391454.1, AA10I255.1,
AA676341.1, AW815833.1, AA169326.1, AW815622.1, AW391447.1, AW815635.1, U69195.1, AA101351.1,
AA908462.1, AA126685.1, AW815508.1, AW815506.1, AW249892.1, AW815512.1, AW609613.1, AA044415.1,
AA678797.1, AW381515.1, AW474060.1, AW351537.1, R12509.1, AA156824.1, AW379059.1, AW371260.1,
AI720441.1, AW189578.1, T23713.1, AW371378.1, AW381482.1, AW381510.1, AW801962.1, AC81496.1,
AA705248.1, R19314.1, T70135.1, AW381476.1, P05151.1, AI206928.1, AW462450.1, AW381459.1, AW843169.1,
AW610177.1, AW393428.1, AW016196.1, AW009270.1, AA092442.1, AW371229.1, AI658933.1, AI919572.1,
AW384329.1, AI708578.1, I79039.1, AW381472.1, P37823.1, AA705236.1, AA895510.1, AC006391.7, AC016175.1,
AL356136.1, AC017078.3, AL135938.7, AC016389.2, AC021003.4, AC017144.1, AC016337.1, AL356266.2,
AL162420.3, AL161719.6, AL161899.2, AC009192.60, AC068789.3, AC051628.10, AC012480.4, AC022926.2,
AC015797.2, AC0I3664.1, AL137250.3, AL356258.2, AL356260.1, AL354999.1, AL160035.3, AL159978.2, AP001532.1,
AP001400.1, AP000590.3,
SEQ ID NO. 225
NGO-St-115
YS1713/T7 3'

L34543.1, L07872.1, L34544.1 NM_015874.1, L08904.1, D14041.1, S63463.1, X17459.1, M81871.1, U60093.1,
U60094.1, M81877.1, M51876.1, L07873.1, AE003830.1, AC005974.1, AL096770.14, AL021578.1, AB024964.1,
AB026048.1, AC012397.31, AC010329.3, AC012147.7, AE003603.1, AE002611.1, AC004506.1, AC007270.2,
AJ239329.2, D25323.1, AA641661.1, AW090508.1, AI627646.1, AI962712.1, AI953614.1, AI401150.1, AW131544.1,
AA701607.1, AW302357.1, AI829826.1, AA501219.1, AI984992.1, AA042864.1, AA640106.1, AA903408.1,
AA483607.1, AA069672.1, AW249681.1, AW235086.1, AI381502.1, AI619912.1, AI291840.1, AI023923.1, T64714.1,
AI580826.1, M375729.1, AI565611.1, AW425207.1, AI334962.1, AI334964.1, AI669755.1, N95392.1, AW005947.1,
AI982567.1, AI144435.1, AA171398.1, AA788576.1, AW815621.1, F33435.1, AI631440.1, AA101255.1, AA676341.1,
AA669918.1, AW815443.1, AA169326.1, AW391454.1, AW815833.1, AA101351.1, U69195.1, AA908462.1,
AW815622.1, AW391447.1, AW815635.1, AW801962.1, AW249892.1, AA126685.1, AA044415.1, AW815508.1,
AW815506.1, AW815512.1, AW609613.1, AA678797.1, AW462450.1, AW381515.1, AW474060.1, AW381537.1,
AA156824.1, AW379059.1, AW371260.1, AI720441.1, R12509.1, AW189578.1, AW371378.1, AW381482.1,
AW381510.1, AW381496.1, T23713.1, I70135.1, AW381476.1, AA705248.1, R19314.1, F05151.1, AW381459.1,
AI206928.1, AW843169.1, AW009270.1, H19326.1, AW016196.1, R45471.1, AW084668.1, AI916589.1, AI435870.1,
AI274998.1, AI095803.1, AA235124.1, AA234950.1, W25228.1, AA092442.1, AI352024.1, AW384329.1, AC006391.7,
AC016175.1, AL356136.1, AL353636.2, AL135938.7, AL158822.4, AC017144.1, AL162420.3, AC069151.1,
AC009192.60, AC068789.3, AC041003.2, AC012480.4, AC053495.2, AC020726.3, AC012297.3,
AC018491.7, AC007532.7, AC013956.1, AC015797.2, AC013664.1, AC013097.1, AL356435.1, AL354999.1,
AL162418.2, AL160035.3, AL159978.2, AL163639.1, AL139023.1, AP001532.1, AP001400.1, AP000590.3,
SEQ ID NO. 226
NGO-St-115
YS1732/T7 3'

L34543.1, L07872.1, L34544.1, NM_015874.1, L08904.1, D14041.1, S63463.1, X17459.1, M81871.1, U60094.1,
U60093.1, AE003830.1, AC005974.1, AC007270.2, AF049850.1, AF016494.1, AL117207.1, D90170.1, D90168.1,
M64933.1, AI627646.1, AI401150.1, AA701607.1, AA641661.1, AI962712.1, AI829826.1, AW131544.1, AI953614.1,
AW302357.1, AA042864.1, AW090508.1, AA640106.1, AI984992.1, AA9034.08.1, AA483607.1, AI291840.1,
AW249681.1, AW235086.1, AI381502.1, AI619912.1, AI580826.1, AI375729.1, AA069672.1, AI334962.1, AI334964.1,
T67414.1, AI669755.1, AI565611.1, N95392.1, AW005947.1, AI144435.1, AI023923.1, AI982567.1, AA788576.1,
F33435.1, AW815621.1, AA501219.1, AA171398.1, AI631440.1, AA10I255.1, AA676341.1, AA169326.1, AW815443.1,
AW391454.1, AW815833.1, AA669918.1, AA101351.1, AA908462.1, AW815635.1, AW815622.1, AW391447.1,
AW425207.1, AW249892.1, AA678797.1, AW815508.1, AA044415.1, AW815506.1, AW815512.1, AW609613.1,
AA126685.1, U69195.1, AW381515.1, AW189578.1, AW474060.1, AA156824.1, AA705248.1,
AW379059.1, AW371260.1, AI720441.1, AW37137&1,R19314.1, Aw381482.1, Aw381510.1, T23713.1, AW38.1496.1,
R12509.1, AI206928.1, F05151.1, AW381476.1, AW610177.1, AW393428.1, AW016196.1, AW381459.1, AW843169.1,
AI658933.1, AW009270.1, AI919572.1, AW371229.1, I70135.1, AA092442.1, AW801962.1, AW462450.1, AI708578.1,
AW384329.1, AW381472.1, AA895510.1, I79039.1, AI401152.1, F37823.1, AC006391.7, AC016175.1, AL356136.1,
AC017144.1, AL162420.3, AC068789.3, AC012480.4, AC022263.4, AC021643.7, AC016390.3, AC013664.1,

TABLE 1-continued

Sequence homologies (GenBank Accession Numbers)

AL354999.1, AL031113.1, AL160035.3, AL159978.2, AL021574.2, AP000590.3, AL020985.1, AL021568.1,
SEQ ID NO. 227
NGO-St-115
YS1792/T7 3'

L34543.1, L07872.1, L34544.1, NM_015874.1, L08904.1, D14041.1, 563463.1, Xl7459.1, M81871.1, U60093.1,
U60094.1, M81877.1, M81876.1, AC007270.2, AF049850.1, AF016494.1, D25323.1, D90170.1, D90168.1, M64933.1,
AI627646.1, AI401150.1, AA701607.1, AA641661.1, AI962712.1, M829826.1, AW131544.1, AA640106.1, AI953614.1,
AA042864.1, AW3023 57.1, AW090508.1, AI984992.1, AA483607.1, AA903408.1, AW249681.1, AW235086.1,
AI381502.1, AI291840.1, AI619912.1, AI580826.1, AA069672.1, T67414.1, AI375729.1, AI023923.1, AI334964.1,
AI565611.1, AI334962.1, AI669755.1, N95392.1, AW005947.1, AI144435.1, AI982567.1, AW815621.1, AA788576.1,
F33435.1, AA501219.1, AA171398.1, AI631440.1, AA101255.1, AA676341.1, AA669918.1, AW815833.1, AW815443.1,
AA169326.1, AW391454.1, AA101351.1, AA908462.1, AW815622.1, AW425207.1, AW391447.1, AW815635.1,
AW249892.1, AA678797.1, AW815508.1, AA044415.1, AW815512.1, AW609613.1, AA126685.1,
AW381515.1, U69195.1, AW474060.1, AW381537.1, AW189578.1, AA156824.1, AI720441.1, AW379059.1,
AW371260.1, AW371378.1, AA705248.1, AW381496.1, AW381482.1, AW381510.1, R12509.1, I23713.1, AW381476.1,
R19314.1, AI206928.1, P05151.1, AW381459.1, AW843169.1, AW610177.1, AW393428.1, AW016196.1, AW009270.1,
170135.1, AI658933.1, AA092442.1, AW371229.1, AI919572.1, AW801962.1, AW4.62450.1, AI708578.1, AW384329.1,
AW381472.1, P37823.1, AA895510.1, AA705236.1, I79039.1, AC006391.7, AC016175.1, AL356136.1, AC010633.4,
AC015575.5, AC011760.8, AL162420.3, AC068789.3, AC012480.4, AC019214.2, AL354999.1, AL160035.3,
AL159978.2, AP000590.3,
SEQ ID NO. 228
NGO-St-115
YS1801/T3,

L07872.1, L34544.1, L34543.1, NM_015874.1, L08904.1, D14041.1, S63463.1, X17459.1, M81871.1, L07873.1,
U60094.1, U60093.1, X59130.1, X59129.1, M81869.1, M81874.1, M81870.1, AB003695.1, M81873.1, M81872.1,
M81875.1, AF085173.1, AE003646.1, AE003411.1, AF047659.1, AC011288.3, AC002338.2, AC007729.2, AE003662.1,
AC006978.2, AC007082.4, AC006263.1, AF003130.1, Y08501.1, U80814.1, X66728.1, X65871.1, AI007973.1,
X58393.1, M94383.1, AE002611.1, AF223391.1, AC024864.1, AC024206.1, AC012329.3, AF104919.1, AL355836.1,
AL157756.2, AL161587.2, AL161492.2, AL132964.2, AL137898.1, AL132962.1, AL035581.1, Z93385.1, Z81086.1,
AL035445.4, U70855.1, X96762.1, AL031135.1, U69195.1, AW462450.1, AI325751.1, AA935398.1, AW084668.1,
AI916589.1, AW801962.1, I79039.1, I70135.1, AA501219.1, W25228.1, AI435870.1, AI274998.1, AI095803.1,
AA235124.1, AA234950.1, R37405.1, AA081973.1, AA101254.1, H19326.1, AW239382.1, AW090508.1, R16902.1,
F04242.1, AA969666.1, R45471.1, AA232981.1, AI352024.1, AW384329.1, T19153.1, AA233367.1, AI953614.1,
R44578.1, F01398.1, AA641661.1, I23712.1, AW384317.1, AA101350.1, AI962712.1, AW425207.1, AW249681.1,
AI627646.1, AI401150.1, AA171575.1, AW131544.1, R19314.1, AA817421.1, AI142713.1, AA736032.1, R71133.1,
AW760949.1, AJ394324.1, AW418568.1, AW221760.1, AW093987.1, AW043304.1, AI995809.1, AV200012.1,
AV198387.1, AV191304.1, AI779257.1, C65393.1, D73771.1, D69291.1, D68255.1, D37730.1, AL356136.1,
AC006391.7, AC019747.1, AC015644.3, AC015641.3, AC068980.2, AC021871.8, AC063967.1, AC024734.3,
AC024447.2, AC006927.22, AC017011.3, AC010780.3, AC025099.1, AC010147.4, AC013569.3, AC017470.1,
AC006714.2, AL353636.2, AL158822.4, AP001377.1, AC012598.9, AC055764.3, AC067725.2, AC025573.4,
AC024560.5, AC036183.2, AC055790.2, AC069123.1, AC069026.1, AC013610.2, AC068491.1, AC024084.2,
AC008751.4, AC008749.4, AC005077.2, AC008267.3, AC027094.2, AC034098.1, AC025889.2, AC016462.3,
AC027268.1, AC025317.2, AC018681.5, AC023815.2, AC018491.7, AC013504.2, AC013097.1, AC006904.2,
AC006900.1, AC006719.1, AL138904.2, AL354990.1, AP000904.2, AP001455.1, AP000706.1, AL009206.1,
SEQ ID NO. 229
NGO-SI-115
Y51801/T7 3'

L34543.1, L07872.1, L34544.1, NM_015874.1, L08904.1, D14041.1, S63463.1, X17459.1, M81871.1, U60093.1,
U60094.1, M81877.1, M81876.1, AE003627.1, AC005734.1, AE003830.1, AC005974.1, AL021578.1, AB024964.1,
AB026048.1, AC012397.31, AC012147.7, AC006729.1, AE003603.1, AE003578.1, AC008261.3, AC017118.3,
AC007270.2, AC005149.1, AF068710.1, AE000051.1, AI239329.2, D25323.1, AW090508.1, AI627646.1, AA641661.1,
AI962712.1, AI953614.1, AI401150.1, AW131544.1, AA701607.1, AW302357.1, AI829826.1, AA501219.1, AI984992.1,
AA042864.1, AA640106.1, AA903408.1, AA483607.1, AA069672.1, AW249681.1, AW235086.1, AI381502.1,
AI619912.1, AI291840.1, AI023923.1, T67414.1, AI580826.1, AW425207.1, AI375729.1, AI565611.1, AI334962.1,
AI334964.1, AI669755.1, N95392.1, AW005947.1, AI982567.1, AI144435.1, AA171398.1, AA788576.1, AW815621.1,
F33435.1, AI631440.1, AA101255.1, AA676341.1, AA669918.1, AW815443.1, AA169326.1, AW391454.1, AW815833.1,
AA101351.1, U69195.1, AA908462.1, AW815622.1, AW391447.1, AW815635.1, AW801962.1, AW249892.1,
AA126685.1, AA044415.1, AW815508.1, AW815506.1, AW815512.1, AW609613.1, AA678797.1, AW462450.1,
AW381515.1, AW474060.1, AW381537.1, AA156824.1, AW379059.1, AW371260.1 AI720441.1, R12509.1,
AW189578.1, AW371378.1, AW381482.1, AW381510.1, AW381496.1, I23713.1, I70135.1, AW381476.1, AA705248.1,
R19314.1, F05151.1, AW381459.1, AI206928.1, AW843169.1, AW009270.1, AW016196.1, AW084668.1, AI916589.1,
AI435870.1, AI274998.1, AI095803.1, AA235124.1, AA234950.1, W25228.1, AA969666.1, AA092442.1, F04242.1,
R45471.1, AW384329.1, AC006391.7, AC016175.1, AL356136.1, AC010631.4, AC025727.1, AC018490.4, AC020100.1,
AL135938.7, AC018869.3, AC017144.1, AL138767.6, AL162420.3, AC009192.60, AC068789.3, AC025573.4,
AC036183.2, AA014003.2, AC012480.4, AC025763.2, AC021089.2, AC011454.3, AC010533.3, AC008785.3,
AC064816.1, AC011124.3, AC055769.1, AC019311.4, AC027284.1, AC015411.3, AC019202.3, AC007532.7,
AC013956.1, AC020022.1, AC015797.2, AC013664.1, AC010694.2, AC006754.1, AL139235.6, AL354999.1,
AL160035.3, AL159978.2, AP001904.1, AP001532.1, AP001400.1, AP000590.3,
SEQ ID NO. 230
NGO-St-115
YS276/T7 3'

L34543.1, L07872.1, L24544.1, NM_015874.1, L08904.1, D14041.1, S63463.1, X17459.1, M81871.1, U60094.1,
U60093.1, M81877.1, L07873.1, AE003830.1, AC005974.1, AL021578.1, AB024964.1, AB026048.1, AC012397.31,

TABLE 1-continued

Sequence homologies (GenBank Accession Numbers)

AC012147.7, AE002611.1, AC007270.2, U64857.1, AF049850.1, AF016494.1, D90170.1, D90168.1, M64933.1,
AA641661.1, AI627646.1, AW090508.1, AI962712.1, AI401150.1, AW131544.1, AA701607.1, AI953614.1, AI829826.1,
AW302357.1, AA042864.1, AI984992.1, AA640106.1, AA903408.1, AA501219.1, AA483607.1, AA069672.1,
AW249681.1, AW235086.1, AI381502.1, AI619912.1, AI291840.1, AI023923.1, T67414.1, AI580826.1, AI375729.1,
AI565611.1, AI334962.1, AI334964.1, AI669755.1, N95392.1, AW815621.1, AW425207.1, AW005947.1, AI982567.1,
AI144435.1, AA171398.1, AA788576.1, P33435.1, AI631440.1, AW815443.1, AA669918.1, AW391454.1, AW815833.1,
AA101255.1, AA676341.1, AA169326.1, AW815622.1, AW391447.1, AW815635.1, AA101351.1, AA908462.1,
U69195.1, AA126685.1, AW815508.1, AW815506.1, AW815512.1, AW609613.1, AW249892.1, AA044415.1,
AA678797.1, AW801962.1, AW381515.1, AW474060.1, R12509.1, AW381537.1, AA156824.1, AW379059.1, I23713.1,
AW371260.1, AI720441.1, AW189578.1, AW371378.1, AW381482.1, AW381510.1, AW381496.1, AW4624501
AA705248.1, R19314.1, F05151.1, I70135.1, AW381476.1, AI206928.1, AW381459.1, AW843169.1, AW610177.1,
AW393428.1, AW016196.1, AA092442.1, AW009270.1, AW371229.1, AI658933.1, AI919572.1, H19326.1,
AW084668.1, AI916589.1, R16902.1, AA235124.1, AI708578.1, AW384329.1, AC006391.7, AC016175.1, AL356136.1,
AC017078.3, AL135938.7, AC017144.1, AL162420.3, AC009192.60, AC068789.3, AC051628.10, AC012480.4,
AC053495.3, AC022926.2, AC018491.7, AC015797.2, AC013664.1, AC013097.1, AC006915.1, AL356260.1,
AL354999.1, AL160035.3, AL159978.2, AP001532.1, AP001400.1, AP000590.3,
SEQ ID NO. 231
NGO-St-115
YS302/T7 3'

L34543.1, L07872.1, L34544.1, NM_015874.1, L08904.1, D14041.1, S63463.1, X17459.1, M81871.1, U60093.1,
U60094.1, M81877.1, M81876.1, AC008408.5, AC011422.2, AE003830.1, AC006356.3, AC005974.1, AL021578.1,
AB024964.1, AB026048.1, AC012397.31, AC012147.7, AE003578.1, AC007115.1, AC007270.2, U66059.1, AP030179.1,
AC005149.1, AF049850.1, AF016494.1, AL133376.6, D25323.1, D90170.1, D90168.1, U07978.1, M64933.1, AI627646.1,
AA641661.1, AW090508.1, AI401150.1, AI953614.1, AI962712.1, AW131544.1, AA701607.1, AI829826.1, AA042864.1,
AW302357.1, AA640106.1, AI984992.1, AA903408.1, AA483607.1, AW249681.1, AW235086.1, AI381502.1,
AI501219.1, AA069672.1, AI619912.1, AI291840.1, AI023923.1, T67414.1, AI580826.1, AI375729.1, AI565611.1,
AI334962.1, AI334964.1, AI669755.1, N95392.1, AW005947.1, AI144435.1, AW515621.1, AI982567.1, AA788576.1,
AA171398.1, AW425207.1, F33435.1, M631440.1, AA669918.1, AW815443.1, AA101255.1, AW391454.1, AA676341.1,
AW815833.1, AA169326.1, AW815622.1, AA10I351.1, AW391447.1, AW815635.1, AA908462.1, AA126685.1,
AW815508.1, AW249892.1, AW815506.1, AW815512.1, AW609613.1, U69195.1, AA044415.1, AA678797.1,
AW381515.1, AW474060.1, AW381537.1, AA156824.1, R12509.1, AW801962.1, AW379059.1, AW371260.1,
AI720441.1, AW189578.1, AW371378.1, T23713.1, AW381482.1, AW381510.1, AW381496.1, AA705248.1, R19314.1,
AW381476.1, FO5151.1, AW462450.1, AI206928.1, I70135.1, AW381459.1, AW843169.1, AW009270.1, AA092442.1,
AW610177.1, AW393428.1, AW016196.1, AW371229.1, AI658933.1, AI919572.1, R16902.1, H19326.1, AI708578.1,
AA235124.1, AA969666.1, AW384329.1, R45471.1, AC006391.7, AC016175.1, AL356136.1, AC011340.3, AC017144.1,
AL162420.3, AC009192.60, AC068789.3, AC012480.4, AC027785.2, AC025508.2, AC012346.3, AC027284.1,
AC009659.3, AC021978.4, AC013448.3, AC020022.1, AC015797.2, AC010694.2, AL137160.4, AL354999.1,
AL160035.3, AL159978.2, AP001532.1, AP001400.1, AP000590.3,
SEQ ID NO. 232
NGO-St-115
YS323/T7 3'

L34543.1, L07872.1, L34544.1, NM_015874.1, L08904.1, D14041.1, S63463.1, X17459.1, M81871.1, U60093.1,
U60094.1, M81877.1, M81876.1, AE003830.1, AC005974.1, AC007270.2, AF049850.1, AF016494.1, D25323.1,
D90170.1, D90168.1, M64933.1, AA641661.1, AI627646.1, AA701607.1, AI962712.1, AW131544.1, AI401150.1,
AW090508.1, AI953614.1, AI829826.1, AA042864.1, AW302357.1, AA640106.1, AI984992.1, AA903408.1,
AW249681.1, AW235086.1, AI381502.1, AI619912.1, AI291840.1, AA483607.1, AI580826.1, AA069672.1, AI375729.1,
AA501219.1, T67414.1, AI56561.1,1, AI023923.1, AI334962.1, AI334964.1, AI669755.1, N95392.1, AI982567.1,
AW005947.1, AI144435.1, AW815621.1, AA788576.1, F33435.1, AA171398.1, AI631440.1, AW815443.1, AA101255.1,
AA676341.1, AW391454.1, AW425207.1, AW815833.1, AA169326.1, AA669918.1, AW815622.1, AW815635.1,
AW391447.1, AA101351.1, AA908462.1, AW815508.1, AW815506.1, AW249892.1, AW815512.1, AW609613.1,
U69195.1, AA126685.1, AA044415.1, AA678797.1, AW381515.1, AW189578.1, AW474060.1, AW381537.1,
AA156824.1, R12509.1, AW379059.1, AW371260.1, AI720441.1, AA705248.1, AW371378.1, I23713.1, AW381482.1,
AW381510.1, AW381496.1, F05151.1, AW381476.1, AI206928.1, R19314.1, AW801962.1, AW381459.1, I70135.1,
AW843169.1, AW610177.1, AW393428.1, AW016196.1, AI658933.1, AA092442.1, AW462450.1, AW009270.1,
AI919572.1, AW371229.1, AW384329.1, AI708578.1, AW381472.1, AA895510.1, F37823.1, R45471.1, R16902.1,
AC006391.7, AC016175.1, AL356136.1, AC017144.1, AL162420.3, AC068789.3, AC012480.4, AC013664.1,
AL354999.1, AL160035.3, AL159978.2, AP000590.3,
SEQ ID NO. 233
NGO-St-115
YS372/T7 3'

L34543.1, L07872.1, L34544.1, NM_015874.1, L08904.1, D14041.1, S63463.1, X17459.1, M81871.1, U60093.1,
U60094.1, M81877.1, M81876.1, AE003830.1, AC005974.1, AC012397.31, AC007270.2, AF049850.1, AF016494.1,
D25323.1, D90170.1, D90168.1, M64933.1, AA641661.1, AI627646.1, AA701607.1, AI962712.1, AW131544.1,
AW090508.1, AI953614.1, AI401150.1, AI829826.1, AA042864.1, AW302357.1, AA640106.1, AI984992.1, AA903408.1,
AA483607.1, AW249681.1, AW235086.1, AI381502.1, AA069672.1, AI619912.1, AI291840.1, AI580826.1, T67414.1,
AI023923.1, AA501219.1, AI375729.1, AI565611.1, AI334962.1, AI334964.1, AI669755.1, N95392.1, AW005947.1,
AI144435.1, AI982567.1, AW815621.1, AA788576.1, F33435.1, AA171398.1, AW425207.1, AI631440.1, AA101255.1,
AW815443.1, AA676341.1, AW391454.1, AA669918.1, AA169326.1, AW815833.1, AW815622.1, AA101351.1,
AW391447.1, AW815635.1, AA908462.1, U69195.1, AW815508.1, AW249892.1, AW815506.1, AW815512.1,
AA126685.1, AW609613.1, AA044415.1, AA678797.1, AW381515.1, AW474060.1, AW381537.1, AW189578.1,
R12509.1, AA156824.1, AW379059.1, AW371260.1, AI720441.1, AW371378.1, AA705248.1, T23713.1, AW381482.1,
AW381510.1, AW381496.1, AW381476.1, R19314.1, I70135.1, F05151.1, AI206928.1, AW801962.1, AW381459.1,
AW843169.1, AW462450.1, AW61 0177.1, AW393428.1, AW016196.1, AW009270.1, AA092442.1, AW371229.1,
AI658933.1, AI919572.1, AW384329.1, AI708578.1, AW381472.1, F37823.1, I79039.1, AA895510.1, AA705236.1,

TABLE 1-continued

Sequence homologies (GenBank Accession Numbers)

AC006391.7, AC016175.1, AL356136.1, AC017144.1, AL162420.3, AC009192.60, AC068789.3, AC012480.4, AC010552.3, AC023549.2, AC022931.3, AC022391.2, AL354999.1, AL160035.3, AL159978.2, AP001005.1, AP000590.3,
SEQ ID NO. 234
NGO-St-115
YS406/T7 3'

L34543.1, L07872.1, L34544.1, NM_015874.1, L08904.1, D14041.1, S63463.1, X17459.1, M81871.1, U60093.1, U60094.1, M81877.1, AE003830.1, AC005974.1, AC007270.2, AF049850.1, AF016494.1, AF035530.1, D25323.1, D90170.1, D90168.1, M64933.1, AA701607.1, AA641661.1, AI627646.1, AI962712.1, AI401150.1, AW131544.1, AW090508.1, AI953614.1, AI829826.1, AA042864.1, AW302357.1, AA640106.1, AI984992.1, AA903408.1, AW249681.1, AW235086.1, AI381502.1, AA483607.1, AI619912.1, AI291840.1, AA069672.1, AI580826.1, T67414.1, AI375729.1, AI023923.1, AI565611.1, AI334962.1, AI334964.1, AA501219.1, AI669755.1, N95392.1, AW005947.1, AI144435.1, M982567.1, AW815621.1, AA788576.1, F33435.1, AA171398.1, AI631440.1, AA101255.1, AA676341.1, AW815443.1, AA169326.1, AW425207.1, AA669918.1, AW391454.1, AW815833.1, AA101351.1, AW815622.1, AA908462.1, AW815635.1, AW391447.1, AW249892.1, AW815508.1, AA044415.1, AW815506.1, AA678797.1, AA126685.1, AW815512.1, AW609613.1, U69195.1, AW381515.1, AW474060.1, AW381537.1, AW189578.1, AA156824.1, AW379059.1, AW371260.1, AI720441.1, AW371378.1, AW381482.1, AW381510.1, AW381496.1, R12509.1, AA705248.1, I23713.1, AW381476.1, AI206928.1, P05151.1, AW381459.1, R19314.1, AW843169.1, I70135.1, AW801962.1, AW610177.1, AW393428.1, AW016196.1, AW462450.1, AI658933.1, AW009270.1, AA092442.1, AW371229.1, AI919572.1, AI708578.1, AW384329.1, AW381472.1, P37823.1, AI274998.1, AA235124.1, W25228.1, AC006391.7, AC016175.1, AL356136.1, AC022173.4, AC009377.5, AC017144.1, AL162420.3,
SEQ ID NO. 235
NGO-St-116
YS1651/T3 5'

M22382.1, NM_002156.1, M34664.1, X54793.1, M22383.1, X55023.1, X53584.1, X53585.1, AC006511.5, M34661.1, AF071216.1, M34660.1, M34663.1, M34662.1, AL096817.12, M34562.1, AJ250915.1, AF227510.1, AL163248.2, U68562.1, D16852.1, AF040153.1, U87959.1, AF121264.1, U94594.1, U38963.1, AL031663.1, Y15783.1, AJ235272.1, AF103898.1, AF103897.1, X70868.1, AF075440.1, U96733.1, X56034.1, U20804.1, AI249625.1, Z66568.2, U72247.1, AI130947.1, AJ130877.1, AP001297.1, D50609.1, Z11547.1, Z12114.1, AF165812.1, X57520.1, X70867.1, AE003485.1, AF031929.1, U17244.1, Z49766.1, M33301.1, X99341.1, AF192796.1, L11390.2, L10917.1, Z12115.1, Z11546.1, L21006.1, L21008.1, I21007.1, X62578.1, AF076436.1, AF076435.1, AF076434.1, AF076433.1, AC006229.17, AF195273.1, AP062533.1, U45241.1, AF085694.1, AF003957.1, M98257.1, Z15160.1, X68263.1, AE003610.1, 040419.1, AC004721.1, M35600.1, AA186560.1, AA315828.1, AA190505.1, AA101281.1, AA196456.1, AA355063.1, AA220969.1, AL118805.1, AW107008.1, AA313717.1, AA211155.1, AW246390.1, AI133536.1, AA130735.1, AA307775.1, AI956302.1, AI526655.1, AA186742.1, AI876755.1, AI789073.1, AA147407.1, AA314982.1, AA066721.1, AA083150.1, AI049243.1, AA153935.1, M788452.1, AA314648.1, AW211098.1, AI119103.1, AA073178.1, AI882194.1, AI875338.1, AA182547.1, AA179642.1, AA333493.1, AI663294.1, AA355152.1, AA308780.1, F06480.1, AW012138.1, AM 14125.1, AA181753.1, AW258808.1, AI891951.1, AI316009.1, AI787944.1, AI931393.1, AW246054.1, AW045067.1, AA218257.1, AW319430.1, AA407305.1, AA361120.1, AW213301.1, AW259849.1, AW012331.1, AA415608.1, AI874815.1, AA375302.1, AA199785.1, AJ398447.1, AW229516.1, AA341141.1, AA355963.1, AW259968.1, R58784.1, AW258893.1, AA355415.1, C89446.1, AA314047.1, AA184322.1, AA087600.1, AA413960.1, AW260552.1, W41752.1, AA333568.1, AA793425.1, AA215942.1, AW773213.1, AL117921.1, AA026155.1, AW784168.1, AA158695.1, AA346637.1, AI980165.1, AI524820.1, N84903.1, AA537973.1, AI709970.1, AA027070.1, N88468.1, AA409877.1, AA096333.1, AA067313.1, AA530483.1, AA301042.1, AA093803.1, AW803755.1, AW803695.1, AC024884.6, AC032001.2, AF252831.1, AC252830.1, AF202031.1, AF189745.1, AC027473.2, AL354869.1, AL160258.3, AC020550.3, AF260011.1, AC008821.4, AC008840.3, AC008511.4, AC009077.5, AC016517.4, AP001561.1, AP000641.1, AL121980.6, AC010746.3, AC018953.5, AC007521.11, AC017670.1, AC023505.8, AC009800.6, AC024321.3, AC053499.2, AC009702.4, AC027301.3, AC007716.2, AC024986.2, AC006440.8, AC013618.3, AC026185.1, AC018811.3, AC018494.3, AC013802.2, AL138997.6, AL158054.5, AL139821.2, AL138683.2, AC068767.2, AC068639.3, AC068036.3, AC044841.2, AC011008.3, AC007996.3, AC010275.4, AC068576.1, AC027239.2, AC023275.2, AC021876.3, AC055878.1, AC047627.1, AC044783.1, AC008709.2, AC015911.4, AC013744.3, AC022484.3, AC011693.4, AC018862.3, AC019325.3, AC023375.2, AC009939.2, AC021304.2, AC019197.3, AC022069.1, AC017455.1, AL356107.2, AL121996.5, AL356059.1, AL133227.1,1, AL353707.1, AL161661.1, AP001998.1, AP001197.1, AP001096.2,
SEQ ID NO. 236
NGO-St-116
YS1651/T7 3'

NM_002156.1, M22382.1, M34664.1, AJ250915.1, AC006511.5, AC004220.1, X53585.1, X54793.1, X53584.1, M22383.1, M34663.1, AF227510.1, AL163248.2, U68562.1, X55023.1, M34661.1, M34662.1, M34660.1, AL096817.12, M34562.1, AF069298.1, AL161494.2, I26035.1, Z12114.1, Z11546.1, X02895.1, AF197942.1, Z81065.1, U58764.1, AE003531.1, AE001112.1, AE000808.1, AL021497.1, Z99568.2, Z81571.1, U13189.1, X54512.1, U01086.1, M74012.1, L21007.1, M10383.1, AC007320.2, NM_006915.1, AC004097.1, U23174.1, U67599.1, U67506.1, AL133396.1, Z35719.1, Z82274.1, Z82253.1, Z70272.1, AJ007590.1, AA550823.1, AA083219.1, AA630404.1, AI832486.1, AA826248.1, AW102810.1, AW131404.1, AI926703.1, AW004895.1, AI922978.1, AI827012.1, AI619432.1, AI627740.1, AI690942.1, AI570191.1, AW276236.1, AI924961.1, AI961421.1, AI956156.1, AI885544.1, AI609776.1, AW469262.1, AA678654.1, AI985757.1, AI683208.1, AW276334.1, AA769669.1, AW304695.1, AW820138.1, AW117832.1, AW177563.1, AW780292.1, AW439804.1, AI818534.1, AW071129.1, AI801296.1, AI571107.1, AW246607.1, AW573149.1, AW513062.1, AA448453.1, AW161433.1, AI565115.1, AA565131.1, AW675607.1, AI221866.1, AI521493.1, AA102391.1, AW410099.1, AI075218.1, AA629677.1, M325539.1, AA564099.1, AW572206.1, AI609928.1, AI189669.1, AW157717.1, AA595763.1, AA600146.1, M612727.1, AI217363.1, AW419186.1, AA167738.1, AI983518.1, AA603962.1, AW246632.1, AI582821.1, AW516994.1, AW156968.1, AW104022.1, AI744383.1, AW513837.1, AW084921.1, AA617879.1, AA515520.1, AW085863.1, AI573195.1, AA609838.1, AI569189.1, AW236411.1, AW192162.1, AI285386.1, AW572335.1, AW674312.1, AW068921.1, AI284071.1, AW674564.1, AI565483.1, AI335167.1, AA847770.1, AA577528.1, AA218869.1, AA181826.1, AA978125.1, AA583474.1, AI023089.1,

TABLE 1-continued

Sequence homologies (GenBank Accession Numbers)

AA605126.1, AA479788.1, AA130632.1, AC010746.3, AC024884.6, AC027473.2, AL136079.3, AC032001.2,
AC026299.2, AL138760.4, AC063980.1, AF252831.1, AF252830.1, AF202031.1, AF189745.1, AF260011.1, AC008821.4,
AC008840.3, AC005511.4, AL354869.1, AL137180.3, AL160258.3, AC016517.4, AP001561.1, AP000641.1,
AC026746.3, AC016645.3, AC026750.2, AC026809.1, AP000799.1, AC006909.1, AC053468.1, AL121980.6, Z98856.1,
AC026022.2, AC018406.2, AL022344.1, Z95399.9, Z99775.8, AL022281.20, AL020986.14, Z92852.20, AL021576.1,
AL022279.5, AL021149.3, Z92855.3, Z92851.5, Z92821.1, Z99005.1, Z95312.1, AL022301.1, AL008880.1, Z98876.1,
AL022283.1, Z98871.1, AL008876.1, Z98869.1, Z98868.1, Z92862.1, Z92861.1, Z99275.1, Z93240.1, Z92856.1,
Z92854.1, Z93245.1, Z93243.1, AL022474.1, AL021347.1, Z96049.1, AL022276.1, AC026640.2, AC023549.2,
AC005308.6, AC016770.4, AL355572.1, AL109808.2,
SEQ ID NO. 237
NGO-St-116
YS1701/T3 5'

M22382.1, NM_002156.1, M34664.1, AC006511.5, M22383.1, X55023.1, X54793.1, X53584.1, AF071216.1, X53585.1,
M34661.1, M34660.1, M34663.1, M34562.1, AJ250915.1, M34662.1, AF227510.1, AL163248.2, AL096817.12,
U68562.1, D16852.1, AF040153.1, AL031663.1, U87959.1, AF121264.1, Y15783.1, AI235272.1, X70868.1, AF075440.1,
U96733.1, X56034.1, AI249625.1, AP001297.1, Z11547.1, Z12114.1, AF165812.1, X70867.1, AE003485.1, AF031929.1,
X99341.1, AF192796.1, L11390.2, L10917.1, Z12115.1, Z11546.1, I21006.1, I21008.1, I21007.1, AC006229.17,
AF195273.1, AF062533.1, AF103898.1, AF103897.1, U23170.1, M98257.1, Z15160.1, X68263.1, AC002304.3,
AC002334.2, AE003610.1, AE001965.1, AC005082.2, U40419.1, U01771.1, AC005908.1, U39703.1, AC004721.1,
AE001104.1, AL163264.2, AL110498.1, AL078623.28, Z94056.1, Z66568.2, U24679.1, AP001719.1, M80811.1,
AP000467.1, D50609.1, M35600.1, AA196456.1, AA190505.1, AA220969.1, AL118805.1, AI133536.1, AA307775.1,
AA315828.1, AW246390.1, AA186742.1, AA313717.1, AA186560.1, AA130735.1, AI526655.1, AA083150.1,
AI956302.1, AA101281.1, AI876755.1, AW107008.1, AA314648.1, AI789073.1, AA153935.1, AI788452.1, AA147407.1,
AI049243.1, AA308780.1, AA179642.1, AI119103.1, AA066721.1, AI882194.1, AA181753.1, AA114125.1, AI663294.1,
AW012138.1, AW246054.1, AA073178.1, AI875338.1, AI891951.1, AW211098.1, M787944.1, AW045067.1,
AA333493.1, AI316009.1, AA375302.1, AW319430.1, AI931393.1, AA341141.1, AW258808.1, AW259849.1,
AA211155.1, AI874815.1, AW213301.1, AA407305.1, AA361120.1, AW012331.1, AA355063.1, AA415608.1,
AW229516.1, AA333568.1, AA218257.1, C89446.1, AW259968.1, AW260552.1, AW258893.1, W41752.1, R58784.1,
AA413960.1, AA087600.1, AA314047.1, AA346637.1, AA314982.1, N88468.1, AA182547.1, N84903.1, AA215942.1,
AA355152.1, F06480.1, AJ398447.1, AA026155.1, AA355415.1, AA301042.1, AW784168.1, AA158695.1, AW773213.1,
AI980165.1, AA184322.1, N87641.1, AA096333.1, AA093803.1, AA793425.1, AW803755.1, AW803695.1, AA223110.1,
AA199785.1, AA355963.1, AL117921.1, AA091450.1, AA248806.1, AA196711.1, AU077229.1, AW645070.1,
AC024884.6, AC032001.2, AF252831.1, AF252830.1, AC027473.2, AF202031.1, AF189745.1, AL354869.1, AC020550.3,
AF260011.1, AL160258.3, AC008821.4, AC008840.3, AC008511.4, AC009077.5, AL121980.6, AC016517.4,
AP001561.1, AP000641.1, AC018953.5, AC007521.11, AC017670.1, AC009800.6, AC024321.3, AC053499.2,
AC009702.4, AC027301.3, AC007716.2, AC024986.2, AC006440.8, AC013618.3, AC013802.2, AL080249.16,
AL138997.6, AL158054.5, AL158800.1, AL139821.2, AL138683.2, AC021068.8, AC068767.2, AC068639.3,
AC044841.2, AC069050.1, AC034292.2, AC011008.3, AC007996.3, AC068576.1, AC023275.2, AC021876.3,
AC055878.1, AC044783.1, AC008709.2, AC013744.3, AC022484.3, AC011693.4, AC018862.3, AC019325.3,
AC023375.2, AC009939.2, AC016289.3, AC019197.3, AC022069.1, AC017455.1, AL121996.5, AL133227.11,
AL353707.1, AL161661.1, Z92863.2, AP001197.1,
SEQ ID NO. 238
NGO-St-116
YS1701/T7 3'

M22382.1, NM_002156.1, M34664.1, AJ250915.1, AC006511.5, M22383.1, X53585.1, X54793.1, X53584.1,
AC004220.1, M34663.1, AL096817.12, AF227510.1, AL163248.2, X55023.1, U68562.1, M34662.1, M34661.1,
M34660.1, M34562.1, AF025468 2, AF069298.1, AL161494.2, L36035.1, AE001727.1, X02895.1, AF240627.1,
AF197942.1, AL109763.2, U58764.1, AC024848.1, AC011594.8, AE001112.1, AE000805.1, Z81571.1, X79205.1,
AP000183.1, AP000038.1, AP000107.1, M74012.1, AC007320.2, AC011592.5, AC008122.15, U67599.1, U67521.1,
AL161505.2, AL133396.1, Z35719.1, AL118497.9, Z82253.1, Z70272.1, AL021367.1, AP001115.1, AA630404.1,
AA826248.1, AI832486.1, AI609776.1, AI926703.1, AI627740.1, AA769669.1, AW004895.1, AI619432.1, AI570191.1,
AW246607.1, AW131404.1, AI818534.1, AI922978.1, AI827012.1, AW102810.1, AI690942.1, AW573149.1,
AA565131.1, AI961421.1, AI221866.1, AW276236.1, AI924961.1, AI956156.1, AA448453.1, AW177563.1, AI683208.1,
AW469262.1, AI885544.1, AW410099.1, AI985757.1, AI678654.1, AA564099.1, AA102391.1, AI325539.1, AI189669.1,
AW304695.1, AW780292.1, AA595763.1, AW071129.1, AW157717.1, AW276334.1, AI217363.1, AW439804.1,
AW117832.1, AA629677.1, AA600146.1, AA603962.1, AW156968.1, AW246632.1, AT801296.1, AI582821.1,
AA167738.1, AI609928.1, AI571107.1, AA948019.1, AW513062.1, AA609838.1, AW675607.1, AA515520.1,
AI565115.1, AI285386.1, AA617879.1, AW068921.1, AI521493.1, AI284071.1, AA847770.1, AI335167.1, AA577528.1,
AA218869.1, AA181826.1, AW572206.1, AA978125.1, AA583474.1, AI023089.1, AW419186.1, AI075218.1,
AI983518.1, AA605126.1, AI612727.1, AW104022.1, AW084921.1, AA774671.1, AA479788.1, AA130632.1,
AW516994.1, AW513837.1, M744383.1, AA970442.1, AA196514.1, AI168478.1, AW085863.1, AI573195.1,
AA219578.1, AA164508.1, AW236411.1, AW192162.1, AW572335.1, AA133938.1, AW674312.1, AC010746.3,
AC024884.6, AC027473.2, AC032001.2, AL136079.3, AL138760.4, AC026299.2, AL354869.1, AC063980.1,
AF252831.1, AF252830.1, AF202031.1, AP189745.1, AC008821.4, AC008840.3, AC005511.4, AL137180.3, AL160258.3,
AF260011.1, AC026746.3, AC016645.3, AC026750.2, AC026809.1, AC016517.4, AP001561.1, AP000641.1,
AP000799.1, AC006909.1, AC009600.11, AC055839.2, AC013509.3, AL121980.6, AC008506.6, AC026610.2,
AC021592.3, AC018406.2, AC021065.3, AL137072.1, Z93927.3, AC009822.3, AC068191.1, AC027003.2, AC016458.2,
AC022269.3, AC018740.2, AC005308.6, AC011267.2, AF188028.1, AC012670.2, AC016998.1, AL356112.2,
AL136358.4, AL158839.2, AL109808.2,
SEQ ID NO. 239
NGO-St-116
YS1731/T7 3'

M22382.1, NM_002156.1, M34664.1, AJ250915.1, A0006511.5, M22383.1, X53585.1, X54793.1, X53584.1,
AC004220.1, AL096817.12, M34663.1, AF227510.1, AL163248.2, X55023.1, U68562.1, M34662.1, M34660.1,

TABLE 1-continued

Sequence homologies (GenBank Accession Numbers)

M34661.1, M34562.1, AF025468.2, AF069298.1 AL161494.2, L36035.1, AF240627.1, AF197942.1, AL163218.2,
AL109763.2, U58764.1, AC024848.1, AC011594.8, AC004038.1, AE000808.1, Z81571.1, AL096701.14, X79205.1,
AP000183.1, AP000038.1, AP000107.1, M74012.1, AC007320.2, AF214118.1, AC005200.1, U67521.1, AL034429.1,
AL161505.2, AL133396.1, Z35719.1, Z82253.1, Z70272.1, AP001115.1, AB019234.1, AA630404.1, AA826248.1,
AI832486.1, AI609776.1, AW246607.1, AA769669.1, AI518534.1, AA565131.1, AW573149.1, AI221866.1, AA448453.1,
AI619432.1, AW177563.1, AI827012.1, AW004895.1, AI926703.1, AI924961.1, AW276236.1, AI627740.1, AW410099.1,
AW102810.1, AI961421.1, AI956156.1, AW131404.1, AI570191.1, AI325539.1, AW157717.1, AI690942.1, AA564099.1,
AI922978.1, AI189669.1, AW469262.1, AI217363.1, AI985757.1, AI885544.1, AI801296.1, AW780292.1, AW276334.1,
AA629677.1, AA600146.1, AA595763.1, AW439804.1, AW117832.1, AI609928.1, AA603962.1, AA102391.1,
AW156968.1, AW071129.1, AW246632.1, AI678654.1, AI582821.1, AW304695.1, AA948019.1, AA167738.1,
AW513062.1, AI683208.1, AI571107.1, AI675607.1, AA609838.1, AI285386.1, AA515520.1, AW068921.1,
AI284071.1, AA617879.1, AI335167.1, AA847770.1, AA218869.1, AW572206.1, AI565115.1, AA577528.1, AA978125.1,
AA181826.1, AW419186.1, AA583474.1, AI983518.1, AI023089.1, AW104022.1, AI521493.1, AA605126.1, AI075218.1,
AA774671.1, AA479788.1, AA130632.1, AW516994.1, AW513837.1, AA084921.1, AI612727.1, AA970442.1,
AI744383.1, AA196514.1, AI168478.1, AI573195.1, AA219578.1, AA164508.1, AW572335.1, AW085863.1,
AW674312.1, AA970965.1, AW192162.1, AA133938.1, AC010746.3, AC024884.6, AC027473.2, AC032001.2,
AL136079.3, AL138760.4, AL354869.1, AC026299.2, AF252831.1, AF252830.1, AF202031.1, AF189745.1, AC008821.4,
AC008840.3, AC005511.4, AC063980.1, AL137180.3, AL160258.3, AP260011.1, AC026746.3, AC016645.3,
AC026750.2, AC026809.1, AC016517.4, AP001561.1, AP000641.1, AP000799.1, AC006909.1, AC055839.2,
AC008506.6, AC025073.2, AC026610.2, AC021592.3, AC018406.2, AC021065.3, AL137072.1, Z95311.10, Z93927.3,
AC009822.3, AC068191.1, AC016458.2, AC018740.2, AC011267.2, AP188028.1, AC012670.2, AL356112.2,
AL158839.2, AL158012.2, AL109808.2,
SEQ ID NO. 240
NGO-St-116
YS1784/T7 3'

AJ250915.1, M22382.1, NM_002156.1, M34664.1, AC006511.5, M22383.1, X54793.1, X53585.1, X53584.1,
AC004220.1, AL096817.12, M34663.1, AF227510.1, AL163245.2, M34662.1, M34660.1, U68562.1, X55023.1,
M34661.1, M34562.1, AP025468.2, AF069298.1, AL161494.2, L36035.1, AF197942.1, U58764.1, AC024848.1,
AC011594.8, AC004195.1, AC005960.1, AE000808.1, Z81571.1, X79205.1, AP000510.2, AP000183.1, AP000038.1,
AB023060.1, AP000107.1, M74012.1, AC007320.2, AC004921.1, AC008122.15, AC000108.1, U67521.1, AL161505.2,
AL133396.1, Z35719.1, AL118497.9, Z82253.1, Z70272.1, AP001115.1, AA630404.1, AA826248.1, AI609776.1,
AW246607.1, AI818534.1, AI832486.1, AW573149.1, AA769669.1, AA565131.1, AI221866.1, AA448453.1,
AW410099.1, AW157717.1, AI325539.1, AI609928.1, AW131404.1, AW177563.1, AI217363.1, AW276236.1,
AW117832.1, AI961421.1, AI926703.1, AI627740.1, AI189669.1, AW469262.1, AI985757.1, AI690942.1, AA600146.1,
AI924961.1, AI619432.1, AI570191.1, AW513062.1, AW246632.1, AW102810.1, AI582821.1, AA564099.1,
AW004895.1, AI922978.1, AI827012.1, AA603962.1, AA629677.1, AA102391.1, AW276334.1, AI956156.1,
AW304695.1, AI678654.1, AI285386.1, AA948019.1, AW156968.1, AW780292.1, AW439804.1, AW071129.1,
AI885544.1, AA595763.1, AI683208.1, AI801296.1, AI571107.1, AM15520.1, AW675607.1, AI284071.1, AW068921.1,
AI335167.1, AA167738.1, AA617879.1, AA609838.1, AW572206.1, AA847770.1, AA218869.1, AW419186.1,
AI565115.1, AA583474.1, AA978125.1, AA181826.1, AI023089.1, AA577528.1, AI983518.1, AA605126.1, AW104022.1,
AA774671.1, AW513837.1, AA479788.1, AA130632.1, AW516994.1, AI521493.1, AI075218.1, AI612727.1,
AA970442.1, AI573195.1, AI744383.1, AI168478.1, AA219578.1, AA164508.1, AW572335.1, AA196514.1,
AW192162.1, AW104912.1, AA970965.1, AW236411.1, AA133938.1, AW674312.1, AC010746.3, AC024884.6,
AC027473.2, AC032001.2, AL136079.3, AL138760.4, AL354869.1, AC026299.2, AF252831.1, AF252830.1, AF202031.1,
AF189745.1, AC008821.4, AC008840.3, AC008511.4, AL137180.3, AL160258.3, AC063980.1, AF260011.1,
AC026746.3, AC016645.3, AC026750.2, AC026809.1, AC016517.4, AP001561.1, AP000641.1, AP000799.1,
AC006909.1, AC055839.2, AC008753.7, AC026610.2, AC018406.2, AC021065.3, AL137072.1, AC009822.3,
AC068191.1, AC064839.3, AC022269.3, AC018740.2, AC005308.6, AC011267.2, AC013285.5, AP188028.1,
AC012670.2, AC006875.1, AL356112.2, AL136358.4, AL159970.7, AL158839.2, AL109808.2,
SEQ ID NO. 241
NGO-St- 116
YS1796/T7 3'

AJ250915.1, M22382.1, NM_002156.1, M34664.1, AC006511.5, M22383.1, X54793.1, X53585.1, X53584.1,
AC004220.1, AL096817.12, M34663.1, AF227510.1, AL163245.2, M34662.1, M34660.1, U68562.1, M34661.1,
X55023.1, AF025468.2, AF069298.1, AL161494.2, L36035.1, X02895.1, AF197942.1, U58764.1, AC024848.1,
AC011594.8, AC004038.1, AE001112.1, AE000808.1, Z81571.1, X79205.1, AP000183.1, AP000038.1, AP000107.1,
M74012.1, AC007320.2, AC008122.15, AC003688.1, AC005200.1, U67521.1, AL034429.1, AL161505.2, AL133396.1,
Z35719.1, AL118497.9, Z82253.1, AL096776.12, Z70272.1, M91463.1, AP001115.1, M34562.1, AA630404.1,
AA826248.1, AW246607.1, AI609776.1, AW410099.1, AI221866.1, AA565131.1, AI818534.1, AI325539.1, AA769669.1,
AI832486.1, AA603962.1, AA448453.1, AW573149.1, AW157717.1, AI189669.1, AW246632.1, AI582821.1,
AI217363.1, AA600146.1, AW177563.1, AA948019.1, AA629677.1, AA515520.1, AA564099.1, AW469262.1,
AW276236.1, AW156968.1, AI961421.1, AI827012.1, AI627740.1, AA102391.1, AI609928.1, AA595763.1, AI285386.1,
AA617879.1, AW780292.1, AW068921.1, AW439804.1, AI284071.1, AA609838.1, AW131404.1, AI619432.1,
AI956156.1, AI926703.1, AA847770.1, AA167738.1, AW102810.1, AI985757.1, AI924961.1, AI571107.1, AW117832.1,
AI570191.1, AI335167.1, AA218869.1, AW004895.1, AA181826.1, AW071129.1, AI801296.1, AA577528.1,
AW304695.1, AI885544.1, AI683208.1, AW675607.1, AW276334.1, AI922978.1, AI678654.1, AA978125.1, AI690942.1,
AA583474.1, AI023089.1, AW513062.1, AW572206.1, AA605126.1, AI565115.1, AA774671.1, AA479788.1,
AA130632.1, AI075218.1, AW516994.1, AW513837.1, AI983518.1, AW104022.1, AA970442.1, AW419186.1,
AI744383.1, AI521493.1, AA196514.1, AI168478.1, AI573195.1, AA219578.1, AA164508.1, AI612727.1, AW236411.1,
AW192162.1, AW104912.1, AA970965.1, AW085863.1, AA133938.1, AW674312.1, AC010746.3, AC024884.6,
AC027473.2, AL136079.3, AC032001.2, AL138760.4, AL354869.1, AF252831.1, AF252830.1, AF202031.1, AP189745.1,
AC008821.4, AC008840.3, AC008511.4, AC026299.2, AL137180.3, AL160258.3, AC063980.1, AF260011.1,
AC026746.3, AC016645.3, AC026750.2, AC026809.1, AC016517.4, AP001561.1, AP000641.1, AC006909.1,
AP000799.1, AC055839.2, AC026610.2, AC021592.3, AC018406.2, AC021065.3, AL354917.1, AL137072.1,
AC009822.3, AC068191.1, AC027003.2, AC016458.2, AC022269.3, AC024740.2, AC018740.2, AC005308.6,

TABLE 1-continued

Sequence homologies (GenBank Accession Numbers)

AC013771.3, AC011267.2, AF188028.1, AC012670.2, AC016998.1, AC009232.2, AL356112.2, AL158839.2,
SEQ ID NO. 242
NGO-St-116
YS353/T7 3'

M22382.1, NM_002156.1, M34664.1, AI250915.1, AC006511.5, M22383.1, X53585.1, X54793.1, X53584.1,
AC004220.1, AL096817.12, M34663.1, AF227510.1, AL163248.2, U68562.1, X55023.1, M34662.1, M34660.1,
M34661.1, M34562.1, AF025468.2, AP069298.1, AL161494.2, L36035.1, X02895.1, AF240627.1, AF197942.1,
AL109763.2, U58764.1, AC024848.1, AC011594.8, AE001112.1, AE000808.1, AL163260.2, Z81571.1, AL096701.14,
X79205.1, AP001715.1, AP000183.1, AP000038.1, AP000107.1, M74012.1, AC007320.2, AC008122.15, AC000108.1,
AC005200.1, U67521.1, AL034429.1, AL161505.2, AL133396.1, Z35719.1, AL118497.9, Z82253.1, Z70272.1,
AP001115.1, AB019234.1, AA630404.1, AA826248.1, AI832486.1, AI609776.1, AA769669.1, AW246607.1, AI818534.1,
AA565131.1, AI619432.1, AW004895.1, AI827012.1, AI926703.1, AI627740.1, AI956156.1, AW102810.1, AI221866.1,
AW573149.1, AI924961.1, AW276236.1, AW131404.1, AA448453.1, AW177563.1, AI961421.1, AI570191.1,
AI922978.1, AW469262.1, AW410099.1, AI690942.1, AA564099.1, AI985757.1, AI325539.1, AI189669.1, AW780292.1,
AI885544.1, AI683208.1, AI678654.1, AA102391.1, AW276334.1, AI801296.1, AW157717.1, AW304695.1, AI217363.1,
AW439804.1, AW071129.1, AA629677.1, AA60014.6,1, AA595763.1, AW117832.1, AA603962.1, AW156968.1,
AW246632.1, AI582821.1, M609928.1, AA948019.1, AW513062.1, AA167738.1, AI571107.1, AW675607.1,
AA609838.1, AA515520.1, M565115.1, AI285386.1, AA617879.1, AW068921.1, AI284071.1, AI521493.1, AA847770.1,
AI335167.1, AA577528.1, AA218869.1, AA181826.1, AW572206.1, AA978125.1, AA583474.1, AI023089.1,
AW419186.1, AI075218.1, AI983518.1, AA605126.1, AI612727.1, AW104022.1, AW084921.1, AA774671.1,
AA479788.1, AA130632.1, AW516994.1, AW513837.1, AI744383.1, AA970442.1, AA196514.1, AI168478.1,
AW0858631, AI573195.1, AA219578.1, AA164508.1, AW236411.1, AW192162.1, AW572335.1, AA133938.1,
AW674312.1, AC010746.3, AC024884.6, AC027473.2, AC032001.2, AL136079.3, AL138760.4, AC026299.2,
AL354869.1, AF252831.1, AF252830.1, AF202031.1, AF189745.1, AC063980.1, AC008821.4, AC008840.3, AC005511.4,
AL137180.3, AL160258.3, AF260011.1, AC026746.3, AC016645.3, AC026750.2, AC026809.1, AC016517.4,
AP001561.1, AP000641.1, AP000799.1, AC006909.1, AC055839.2, AC026610.2, AC021592.3, AC018406.2,
AC021065.3, AL137072.1, AC009822.3, AC026803.2, AC068191.1, AC027003.2, AC016458.2, AC018740.2,
AC005308.6, AC011578.3, AC011267.2, AC012670.2, AC016998.1, AC009232.2, AL356112.2, AL109808.2,
SEQ ID NO. 243
NGO-St-117 combined;

NM_006117.1, AF153612.1, AF244138.1, AF069301.1, AF257175.1, D17030.1, NM_0118681 AF153613.1, D17201.1,
S80107.1, M15888.1, AL163270.2, AP001725.1, AP000689.1, AB003151.1, U11419.1, NM_0125741 NM_008171.1,
NM_000834.2, AC005232.1, AC011915.3, U88963.1, AF111103.1, U11287.1, U90278.1, M91562.1, D10651.1,
AC007000.2, NM_000508.1, AC004843.1, AC006014.2, AC004955.2, AC005488.2, AC007786.1, AC002082.1,
AC006504.1, M58569.1, L11356.1, AC005355.1, AC005273.1, U72724.1, U09205.1, AL158111.2, X62844.1, J00128.1,
J00127.1, AB022216.1, M64982.1, AC007042.2, AC016830.5, AC011525.4, AC008101.15, AC002377.1, AC004953.1,
AC007773.1, AF016667.2, AC005796.1, AJ009632.2, M96930.1, M13968.1, M77812.1, X79424.1, AI870279.1,
AI807002.1, AL036852.1, AI564314.1, AI565595.1, W67775.1, AW270727.1, AI610377.1, AW662848.1, AL046860.2,
AA617696.1, AA934587.1, AI096931.1, AA628682.1, AW731836.1, AA913577.1, AI391743.1, AW474447.1,
AI363079.1, AI336097.1, AI432577.1, AI352108.1, AI352327.1, AA969876.1, AA995606.1, W74527.1, AA622402.1,
AI085901.1, AA027090.1, AI307399.1, W28824.1, AI971940.1, AI287814.1, AA620556.1, W79046.1, AA980052.1,
AW194674.1, AW182085.1, AA085733.1, AA187157.1, AI625204.1, AI031865.1, AA426250.1, AW591699.1,
AA897169.1, AA393863.1, AA972318.1, AI349588.1, AI674578.1, AI659404.1, AW750808.1, AW302400.1,
AA027130.1, AA115569.1, F36532.1, AI371256.1, AW023925.1, AA365494.1, AA733183.1, AA531124.1, F30300.1,
AA282967.1, AA380734.1, I71475.1, T90909.1, Z25096.1, AI432578.1, AA380387.1, AA157205.1, AW088726.1,
AA721771.1, AA115089.1, T83325.1, T49643.1, R00622.1, T&3700.1, N93780.1, F00243.1, AI872750.1, R00626.1,
R00525.1, AI471045.1, R08138.1, R00521.1, AW369701.1, AA380460.1, N74066.1, AI909238.1, AI370415.1, W67774.1,
AA658299.1, T55344.1, AW744236.1, AW742885.1, AU079751.1, AI930460.1, AI528379.1, AW210430.1, AA118832.1,
AA153061.1, AL033383.25, AL136309.3, AL355594.3, AC021873.7, AC068763.2, AC022912.3, AC034235.2,
AC021642.11, AC024709.4, AC025502.2, AC024325.2, AC011986.3, AL137142.8, AL133407.4, AL139254.3,
AL354955.1, AL354859.1, AP001804.1, AC020947.5, AC007003.2, AC004867.2, AC027394.2, AC007343.3,
AC012350.3, AC023284.1, AC016456.2, AC013532.2, AC005143.1, AC004581.1, AL353618.2, AP000796.1,
SEQ ID NO. 244
NGO-St-117
YS025/T3 5'

AF257175.1, AF069301.1, AF244138.1, NM_0061171 AF153612.1, D17030.1, NM_0118681 AF153613.1, S80107.1,
M15888.1, AE003426.1, NM_000508.1, M58569.1, L11356.1, U09205.1, M16153.1, AL132964.2, AL035436.3, I00128.1,
J00127.1, X17570.1, M64982.1, AC022078.12, AC020647.9, AC006392.1, AF001548.1, AC005034.1, AC011331.1,
AF123727.1, AF058692.1, AF058691.1, AL034426.4, X97253.1, AB020673.1, M77812.1, L23921.1, D10667.1,
AL046860.2, AA188052.1, W28824.1, AI971940.1, AA380387.1, F00243.1, AA157205.1, AW023925.1, AA531124.1,
AU079751.1, AI930460.1, AI528379.1, AA353778.1, AW476551.1, AW210430.1, AA380460.1, AA24.4463.1,
AA137720.1, AA118832.1, W97106.1, AA674322.1, AI020701.1, AA645183.1, AI892596.1, AI019310.1, AA717623.1,
W48327.1, AI155958.1, AI025290.1, AA153061.1, AW463230.1, AW462175.1, AW359742.1, AW323611.1, AI653280.1,
AI217226.1, AI208802.1, AI028745.1, AI018748.1, AA815401.1, AA412669.1, AA399269.1, AW750808.1, AW742226.1,
AA103723.1, AA030780.1, AW743307.1, AW229796.1, AA066905.1, AW012459.1, AA575384.1, AW478977.1,
R00525.1, AA467514.1, W89322.1, N55668.1, R00521.1, AI909238.1, AA690248.1, AI303965.1, AA717411.1,
AA426250.1, AA393863.1, AI891995.1, AI891994.1, AI891993.1, AI789433.1, AA277873.1, AA675395.1, AA980640.1,
AI154739.1, W78509.1, AA813227.1, AI154475.1, AA210546.1, AA145999.1, AV123543.1, AI509051.1, AI203473.1,
AW320942.1, AA282967.1, W67774.1, AW805054.1, AI207457.1, AI133428.1, AI114445.1, AA800548.1, AA436648.1,
AA382695.1, AA344542.1, AA026737.1, N33594.1, H67459.1, T95711.1, I74407.1, I73868.1, I72304.1, I71715.1,
T61743.1, T60362.1, AL355594.3, AL033383.25, AL136309.3, AL354935.3, AL161792.4, AC024709.4, AL354859.1,
AL160291.2, AC025257.5, AC032040.2, AC012350.3, AC009583.3, AC024470.2, AC023284.1, AC010883.3,
AC013106.1, AL353618.2, AP000796.1, AC008250.16, AC024904.5, AC046176.2, AC026761.2, AC068593.1,
AC008761.3, AC066731.1, AC026932.2, AC047816.1, AC049963.1, AC039392.1, AC009616.3, AC026082.3,

TABLE 1-continued

Sequence homologies (GenBank Accession Numbers)

AC016089.4, AC018827.4, AC025553.2, AC011660.4, AC018607.3, AC023879.2, AC023571.2, AC019037.2, AC012655.4, AC022661.2, AC010683.3, AC012579.2, AC019027.2, AF128834.1, AL355353.3, AL162291.8, AL355680.2, AL136322.2, AL136158.12, AL138801.5, AL136526.15, AL353808.1, AL122035.2, AP001991.1, AP001851.1,
SEQ ID NO. 245
NGO-St-117
YS025/T7 3'

NM_006117.1, AF153612.1, AF069301.1, AF257175.1, AF244138.1, NM_011868.1, AF153613.1, AL163270.2, AP001725.1, AP000689.1, AB003151.1, U11419.1, NM_01574.1, NM_008171.1, NM_000834.2, AC005232.1, AC011915.3, U88963.1, AP111103.1, AC005304.1, U11287.1, U90278.1, M91562.1, D10651.1, AE003498.1, AC007000.2, AC004843.1, AC006014.2, AC005488.2, AC004878.2, AC007786.1, AC002082.1, AC005071.2, AC006504.1, AC005355.1, AC005273.1, U72724.1, AL121767.3, AL133233.2, AB022216.1, AC011525.4, AC004953.1, AC006487.7, AL352976.2, AJ239322.3, AP001135.2, AI870279.1, AI807002.1, AL036852.1, AI564314.1, AI565595.1, W67775.1, AW270727.1, AI610377.1, AW662848.1, AA617696.1, AA934587.1, AI096931.1, AA628682.1, AW731836.1, AA913577.1, AI391743.1, AW474447.1, AI363079.1, AI336097.1, AI432577.1, AI352108.1, AI352327.1, AA969876.1, AA995606.1, W74527.1, AA622402.1, AI085901.1, AA027090.1, AI307399.1, AI287814.1, AA620556.1, W79046.1, AW194674.1, AW182085.1, AA085733.1, AA187157.1, AI625204.1, AI031865.1, AW591699.1, AA897169.1, AA972318.1, AI349588.1, AI674578.1, AT659404.1, AA265494.1, AW302400.1, F36532.1, AI371256.1, AA733183.1, AA531124.1, P30300.1, AA027130.1, AA115569.1, AI370734.1, T90909.1, Z25096.1, I71475.1, AI432578.1, AA426250.1, AW088726.1, T83700.1, AA721771.1, AA393863.1, AA115089.1, T49643.1, R00622.1, AA282967.1, T83325.1, N93780.1, AW750808.1, AI872750.1, R00626.1, R08138.1, AI471045.1, AW369701.1, N74066.1, M370415.1, AA003997.1, AW744236.1, AA250467.1, AA658299.1, AA968175.1, AA848318.1, AW742885.1, T55344.1, AW557746.1, AI877303.1, AW208617.1, AA260498.1, AW322345.1, AI500088.1, AA958697.1, AA397074.1, AA008542.1, AA036229.1, AA253686.1, AW456866.1, AI931743.1, AI411403.1, AW743789.1, AL033383.25, AL136309.3, AL355594.3, AC021873.7, AC068763.2, AC022912.3, AC034235.2, AC021642.1,1, AC025224.3, AC025502.2, AC024325.2, AC019078.3, AC016030.2, AL137142.8, AL133407.4, AL139254.3, AL354955.1, AP000916.2, AP001804.1, AC055832.2, AC004166.10, AC020947.5, AC010246.4, AC010348.3, AC061712.2, AC009061.8, AC005073.2, AC007003.2, AC010139.3, AC027394.2, AC012350.3, AC010947.3, AC025740.1, AC013532.2, AC024932.3, AC025817.2, AC019142.4, AC034105.1, AC010760.2, AC016441.4, AL356139.2, AL137024.6, AL133403.6,
SEQ ID NO. 246
NGO-St-117
YS062/T3 5'

NM_006117.1, AF153612.1, AF244138.1, AF257175.1, AF069301.1, D17030.1, NM_011868.1, AF153613.1, D17201.1, S80107.1, M15888.1, NM_000508.1, M58569.1, L11356.1, U09205.1, J00128.1, J00127.1, M64982.1, AE003488.1, AC020647.9, AF001548.1, AC005034.1, AC011331.1, AF123727.1, AE001039.1, AL034426.4, X97253.1, AB020673.1, M77812.1, D10667.1, AL046860.2, W28824.1, AI971940.1, AA188052.1, AW023925.1, AA380387.1, AA157205.1, P00243.1, AW750808.1, AA426250.1, AA393863.1, AA380460.1, R00525.1, R00521.1, AI909238.1, AU079751.1, AI930460.1, AI528379.1, N55668.1, AW476551.1, AW210430.1, AA244463.1, AA137720.1, AA118832.1, W97106.1, AA674322.1, AI020701.1, AA645183.1, AI892596.1, AA531124.1, AI019310.1, AA717623.1, W48327.1, AI155958.1, AI025290.1, AA153061.1, AA282967.1, W67774.1, AA353778.1, AW463230.1, AW462175.1, AW359742.1, AW323611.1, AI653280.1, AI217226.1, AI208802.1, AI028745.1, AI0187481, AA815401.1, AA412669.1, AA399269.1, AW742226.1, AA103723.1, AA030780.1, AW743307.1, AW229796.1, AA066905.1, AW012459.1, AA575384.1, AW478977.1, AA467514.1, AA115569.1, W89322.1, AA027130.1, AA690248.1, AI891994.1, AI891993.1, AI789433.1, AI303965.1, AA717411.1, AA277873.1, AI509051.1, AI891995.1, AI154739.1, AA675395.1, AI564314.1, AA980640.1, AI608378.1, W78509.1, AA289292.1, AA813227.1, AI121770.1, W91218.1, AW744236.1, AI154475.1, AA210546.1, AA145999.1, T83700.1, R08138.1, AV123543.1, AI203473.1, AW320942.1, AA800548.1, AA382695.1, AA344542.1, AA026737.1, H67459.1, I74407.1, I73868.1, T60362.1, AL355594.3, AL033383.25, AL136309.3, AC024709.4, AL354859.1, AL160291.2, AC025257.5, AC032040.2, AC012350.3, AC009583.3, AC024470.2, AC023284.1, AC010883.3, AC008300.1, AL35361&, AP000796.1, AC008250.16, AC024907.2, AC026761.2, AC011351.3, AC011368.3, AC068593.1, AC026932.2, AC009616.3, AC026082.3, AC016089.4, AC018827.4, AC012111.3, AC025553.2, AC011660.4, AC023879.2, AC023571.2, AC019037.2, AC012655.4, AC020885.2, AC022661.2, AC010683.3, AC019027.2, AC012729.1, AL157833.5, AL355353.3, AL162291.8, AL355680.2, AL136322.2, AL136158.12, AL138801.5, AL136526.15, AL353808.1, AL122035.2, AP001991.1, AP001851.1,
SEQ ID NO. 247
NGO-St-117
YS062/T7 3'

NM_006117.1, AF153612.1, AF069301.1, AF244138.1, AF257175.1, NM_011868.1, AF153613.1, AL163270.2, AP001725.1, AP000689.1, AB003151.1, U11419.1, NM_012574.1, NM_008171.1, NM_000834.2, AC005232.1, AC011915.3, AC007535.3, U88963.1, AP111103.1, AC005304.1, U11287.1, U90278.1, M91562.1, D10651.1, AE003498.1, AC007000.2, AC004843.1, AC006014.2, AC004955.2, AC005458.2, AC004878.2, AC007786.1, AC002082.1, AC005071.2, AC006504.1, AC005355.1, U72724.1, AE000665.1, AL121767.3, AL133233.2, AB022216.1, AF260700.1, AC011525.4, AP182322.1, AC004953.1, AC006487.7, AC005796.1, AL352976.2, AL353820.1, AJ239322.3, AJ239318.3, Z75955.1, AJ009632.2, AP001342.1, AP001135.2, M16512.1, M80474.1, M13968.1, X79424.1, M870279.1, AI807002.1, AL036852.1, AI565595.1, AI564314.1, W67775.1, AW270727.1, AI610377.1, AW662848.1, AA617696.1, AA934587.1, AI096931.1, AA628682.1, AW731836.1, AA913577.1, AI391743.1, AW474447.1, AI363079.1, AI336097.1, AI432577.1, AI352108.1, AI352327.1, AA969876.1, AA995606.1, W74527.1, AA622402.1, AI085901.1, AA027090.1, AI307399.1, AI287814.1, AA620556.1, AW194674.1, W79046.1, AW182085.1, AA085733.1, AA187157.1, AI625204.1, AI031865.1, AW591699.1, AA897169.1, AA972318.1, AI349588.1, AI674578.1, AI659404.1, AW302400.1, P36532.1, AI371256.1, AA733183.1, AA531124.1, AA365494.1, F30300.1, AI370734.1, T90909.1, Z25096.1, AA027130.1, AA115569.1, I71475.1, AI432578.1, AW088726.1, AA721771.1, AA115089.1, T49643.1, R00622.1, T83325.1, AA426250.1, N93780.1, T83700.1, AA393863.1, AA282967.1, AI872750.1, R00626.1, AI471045.1, AW750808.1, AW369701.1, R08138.1, N74066.1, AJ370415.1, AA658299.1, T55 344.1, AA003997.1, AW744236.1, AW742885.1, AA250467.1, AW557746.1, AW208617.1, AA968175.1, AW322345.1, AI500088.1, AA260498.1, AA848318.1,

TABLE 1-continued

Sequence homologies (GenBank Accession Numbers)

AA958697.1, AI877303.1, AA397074.1, AA008542.1, AA036229.1, AW456866.1, AI931743.1, AA253686.1, AW743789.1, AI411403.1, AL033383.25, AL136309.3, AL355594.3, AC021873.7, AC068763.2, AC022912.3, AC034235.2, AC025224.3, AC025502.2, AC024325.2, AC019078.3, AL137142.8, AL133407.4, AL139254.3, AL354955.1, AP000916.2, AP001804.1, AC055832.2, AC004166.10, AC020947.5, AC010246.4, AC010348.3, AC009061.8, AC067929.1, AC025127.2, AC005073.2, AC007003.2, AC004867.2, AC027394.2, AC012350.3, AC010947.3, AC025740.1, AC018553.2, AC013532.2, AL355552.1, AL139294.1,
SEQ ID NO. 248
NGO-St-117
YS286/T7 3'

NM_006117.1, AF153612.1, AF069301.1, AF257175.1, AF244138.1, NM_011868.1, AF153613.1, AP000689.1, AB003151.1, U11419.1, NM_012574.1, NM_008171.1, NM_000834.2, AC005232.1, AC011915.3, U88963.1, AF111103.1, AC005304.1, IJ11287.1, U90278.1, M91562.1, D10651.1, AE003498.1, AC007000.2, AC004843.1, AC006014.2, AC005488.2, AC004878.2, AC007786.1, AC002082.1, AC005071.2, AC006504.1, AC005355.1, AC005273.1, U72724.1, U17243.1, AL121767.3, AL133233.2, AB022216.1, AC011525.4, AF024504.2, AC004953.1, AC007773.1, AC006487.7, AC005796.1, AL352976.2, AI239322.3, Z75955.1, AP001342.1, AP001135.2, M870279.1, M807002.1, AL036852.1, AI564314.1, AI565595.1, W67775.1, AW270727.1, AI610377.1, AW662848.1, AA617696.1, AA934587.1, AI096931.1, AA628682.1, AW731836.1, AA913577.1, AI391743.1, AW474447.1, AI363079.1, AI336097.1, AI432577.1, AI352108.1, AI352327.1, AA969876.1, AA995606.1, W74527.1, AA622402.1, AI085901.1, AA027090.1, AI307399.1, M287814.1, AA620556.1, W79046.1, AW194674.1, AW182085.1, AA085733.1, AA187157.1, AI625204.1, AI031865.1, AW591699.1, AA897169.1, AA972318.1, AI349588.1, M674578.1, AI659404.1, AA365494.1, AW302400.1, F36532.1, AI371256.1, AA733183.1, AA531124.1, AA027130.1, AA115569.1, F30300.1, AI370734.1, T90909.1, Z25096.1, I71475.1, AI432578.1, AA426250.1, AW088726.1, T83700.1, AA393863.1, AA721771.1, AA115089.1, T49643.1, AA282967.1, R00622.1, T83325.1, N93780.1, AW750808.1, AI872750.1, R00626.1, R08138.1, AI471045.1, AW369701.1, N74066.1, AI370415.1, AA658299.1, AA003997.1, AW744236.1, AA250467.1, T55344.1, AA848318.1, AA968175.1, AW742885.1, AW322345.1, AW208617.1, AW557746.1, AI877303.1, AI500088.1, AA260498.1, AA958697.1, AA397074.1, AA008542.1, AA036229.1, AW456866.1, AI931743.1, AI411403.1, W67774.1, AL033383.25, AL136309.3, AL355594.3, AC021873.7, AC068763.2, AC022912.3, AC034235.2, AC025224.3, AC025502.2, AC024325.2, AC019078.3, AL133293.18, AL137142.8, AL133407.4, AL139254.3, AL354955.1, AP000916.2, AP001804.1, AC055832.2, AC004166.10, AC020947.5, AC010246.4, AC010348.3, AC061712.2, AC009061.8, AC005073.2, AC007003.2, AC010139.3, AC004867.2, AC027394.2, AC012350.3, AC011039.4, AC010947.3, AC025740.1, AC013532.2, AC005143.1, AL355487.1,
SEQ ID NO. 249
NGO-St-118
YS1802/T7 3'

NM_001655.1, X81198.1, AFIII103.1, AFIII102.1, S74341.1, AF1518701 NM_016049.1, AE003475.1, AL136295.2, U32692.1, AF019376.1, Z70680.1, AE003528.1, AC004931.1, AE000604.1, AC006050.1, AL117667.2, AL096862.18, Z46793.1, AL035250.17, AL031224.1, Z99289.1, AL109798.19, AL112548.1, L29789.1, AA412680.1, AI755123.1, AA102578.1, AA206349.1, AW055098.1, AA293170.1, AW439825.1, AW269634.1, AI076926.1, AI025067.1, AI700509.1, AI078164.1, AI697821.1, AA705915.1, AI160192.1, AI093354.1, AA165600.1, AA705055.1, AA527537.1, AA192464.1, AI653666.1, AI264667.1, AI650293.1, AI091869.1, AA506760.1, AI950897.1, AI380068.1, AI264617.1, AI125887.1, AA047461.1, AI890839.1, AI683902.1, N24749.1, N32156.1, AI302074.1, AA088764.1, N26132.1, AI040426.1, AI358017.1, AI141871.1, AW474078.1, AI523696.1, N32947.1, AA688242.1, AI961853.1, AI446329.1, AI002397.1, AA993720.1, AA707731.1, AA422132.1, H99310.1, AI879755.1, AI918396.1, AA804436.1, AA928305.1, AW168784.1, AA719418.1, M087106.1, AI024105.1, AW129693.1, W15326.1, H94333.1, AI962023.1, W42458.1, N21273.1, AW194030.1, AA856562.1, AI758429.1, AA243440.1, AA434593.1, W85810.1, AI079791.1, H99597.1, N67805.1, AA808672.1, AW303758.1, AI769314.1, R76982.1, AI754941.1, N42618.1, H98545.1, AA599213.1, AI832336.1, AA811624.1, H88780.1, AI886101.1, AI474209.1, H88997.1, N94593.1, AI888666.1, AA055972.1, AA788790.1, AA491237.1, AI401139.1, K96031.1, T99642.1, AA598401.1, AA026110.1, Z40496.1, AI658990.1, AP000941.2, AP000846.1, AP000869.1, AC019068.3, AC019509.1, AC010015.3, AC036149.2, AC027187.2, AC025241.2, AC026015.2, AC027724.1, AC012532.3, AC015914.3, AC022658.3, AC024732.2, AC016276.2, AC002317.1, AL163952.1, AL135929.4, AC000380.1, AL135909.3, AC020636.4, AC023892.11, AC010856.3, AC055864.2, AC023156.3, AC068590.1, AC025079.3, AC023169.3, AC013670.3, AC021378.3, AC060765.1, AC058803.1, AC021150.5, AC013386.4, AC019162.3, AC027521.1, AC018425.3, AC012274.2, AC024231.3, AC025978.1, AC013331.4, AC016418.4, AC023018.2, AC021567.2, AC011783.3, AC012436.4, AC020636.3, AC010066.5, AC011892.3, AC014423.1, AL121919.13, AL353638.2, AL160285.5, AL139284.3, AL356033.1, AL354000.2, AL354985.2, AL161451.4, AL157950.3, AL353774.1, AL160290.3, AL139003.1, AP001393.1,
SEQ ID NO. 250
NGO-St-119
YS334/T3 5'

NM_003146.1, M86737.1, S50213.1, L08814.1, L08815.1, U84139.1, AB004793.1, AE003462.1, X68408.1, L08825.1, AL031904.1, AL035653.12, AC007058.2, U40759.1, NC_001145.1, AE003662.1, AE002914.1, AE003202.1, AE002711.1, AC007285.3, AL163298.2, AL163002.1, S74619.1, Z48622.1, AP001753.1, AB001517.1, AP001055.1, Z79396.1, AW247262.1, AA258912.1, AA443507.1, AA085435.1, AA312302.1, F07281.1, AA359039.1, D55248.1, D54571.1, D54563.1, D54952.1, D54973.1, AW802206.1, D53930.1, AA355756.1, AA404188.1, AI556014.1, AA104553.1, AL138347.1, AW489221.1, AA253486.1, AW320565.1, AA088369.1, I110266.1, AW401443.1, D77299.1, AW381661.1, AA993395.1, AA464881.1, AA036329.1, AI913779.1, AA476079.1, AA306252.1, AA590151.1, AW748405.1, AW366265.1, AA130307.1, M789443.1, AW378315.1, AW269617.1, AW370347.1, AW480897.1, AA497585.1, AW536819.1, AW536546.1, AU060291.1, AA162184.1, W07230.1, AP000781.2, AC020482.1, AC009182.3, AL139094.5, AC044849.2, AC020624.5, AC016588.5, AC010741.3, AL161790.3, AC068888.2, AC013552.4, AC022413.3, AC011472.5, AC068473.1, AC024176.4, AC019023.3, AC019286.4, AC024462.2, AC020561.2, AC016441.4, AC022770.4, AC025303.1, AC006286.13, AC021638.5, AC018018.1, AC018205.1, AC003656.1, AL356318.1, AL355178.2, AL133463.8, AL160401.4, AL139816.4, AL158160.1, AL118500.5,

TABLE 1-continued

Sequence homologies (GenBank Accession Numbers)

SEQ ID NO. 251
NGO-St-119
YS334/T7 3'

NM_003146.1, M86737.1, 550213.1, U84139.1, L08814.1, AC007967.3, AC017111.4, AC026237.4, AC005313.2,
AF130357.1, AC004918.1, AF131217.2, AF165124.1, AL163247.2, AL021938.1, AL035534.1, AB037738.1, AI200891.1,
AI832834.1, AI694393.1, AI597819.1, AA773470.1, AA640958.1, AI989881.1, AI954549.1, AA669346.1, AL043692.1,
AA872063.1, AW771391.1, AI653466.1, AA488456.1, AI770053.1, AI719199.1, AA181676.1, AI768076.1, AW250844.1,
AI769368.1, AI326218.1, AI292284.1, AA102606.1, AS583325.1, AA630377.1, AW246563.1, AI803290.1,
AW469194.1, AW072040.1, AI801767.1, AA129398.1, AA129437.1, N47701.1, AW055203.1, AA204842.1, AA403256.1,
AW162590.1, AW873160.1, N47715.1, AA428207.1, AI802539.1, AW474265.1, AW517489.1, AA155636.1,
AA187844.1, AI708178.1, AI298177.1, AA084865.1, AW196881.1, M802262.1, AA223606.1, AA188417.1,
AW182589.1, AW601976.1, M125376.1, AA983384.1, AI669267.1, AA047175.1, AI369594.1, AA640599.1,
AA629829.1, AA506517.1, AA426576.1, AI034453.1, AI927125.1, AI198409.1, AA088196.1, AA644298.1, AA172185.1,
AI024913.1, AA282185.1, AW772651.1, AA418911.1, AA679982.1, AA232539.1, AA928645.1, AI421368.1,
AW516350.1, AI249088.1, AA770296.1, AL042406.1, AI913779.1, AA102637.1, W92454.1, AW732257.1, AW194956.1,
M433062.1, AA203343.1, AA581113.1, I29388.1, AA258817.1, AA173277.1, AW873703.1, AI569301.1, AA522909.1,
H10212.1, AW138326.1, AI630694.1, AI475149.1, AA367901.1, AP000781.2, AC068719.1, AL355364.3, AC021659.7,
AC008383.4, AC010757.2, AC009475.3, AC012291.3, AC027118.2, AC023547.2, AC026245.1, AC011808.3,
AC007856.6, AC015665.2, AL136227.4, AL356094.1,
SEQ ID NO. 252
NGO-St-120
YS357/T3 5'

NM_013285.1, L05425.1, U69600.1, AL034379.8, AL021571.1, AB015478.1, X99436.1, AC024751.1, AC006920.10,
NM_009722.1, NM_001681.1, AC006581.16, AJ223584.1, AJ131821.1, AL121578.1, AL008715.1, X52496.1, X02814.1,
M23115.1, M23114.1, Z11500.1, I04703.1, AF235167.1, AE003511.1, AC002045.1, AC007216.2, U95742.1,
AC002299.1, AF196970.1, AC007283.3, AF013149.1, AF152363.1, AC005844.7, AC005841.3, AF001549.1,
AC000385.1, AL049988.1, AL109865.36, Z50028.1, Z68325.1, Z82204.1, AL049849.1, 575106.1, AK000019.1,
AB020863.1, X07653.1, AA373618.1, AW245855.1, AW161434.1, AW409934.1, AW163245.1, AA126101.1,
AA690847.1, AW377646.1, AA858436.1, AL024316.1, AW377648.1, AW427911.1, I135824.1,
AI112354.1, AI573674.1, AA684606.1, AI035443.1, AA316055.1, AA171883.1, AV125438.1, AI853194.1, AA308223.1,
AW326870.1, AV125326.1, AA692026.1, AV138378.1, AA303227.1, AA581348.1, AW765532.1, AA989948.1,
C70491.1, AW773907.1, D23001.1, AV442312.1, AW650351.1, AI994797.1, AI488290.1, N38238.1, T80141.1,
AW736578.1, M077091.1, AI908898.1, AI847850.1, AI776439.1, AI467314.1, AI382397.1, AI290588.1, AI091365.1,
AA414121.1, AA409715.1, AA038677.1, AW738493.1, AI709211.1, AI661426.1, AI482631.1, AI114591.1, D78236.1,
AA742179.1, AA744826.1, AA663314.1, AA594218.1, AA452237.1, AA410224.1, AA298534.1, AA199847.1, H74324.1,
R99587.1, AC023077.3, AC027731.2, AL355880.2, AC011124.3, AC018953.5, AC023502.3, AC026155.3, AC024905.7,
AC067611.1, AC064107.1, AC056245.1, AC033416.1, AC027813.1, AC021828.2, AL138975.1, AC026677.2,
AC022164.4, AC022147.4, AC023398.2, AC027006.2, AC025043.3, AC017041.2, AC016838.3, AC023448.2,
AC021481.3, AC019325.3, AC023958.2, AC025279.1, AC022408.3, AC016492.1, AP001767.1, AP001120.1,
SEQ ID NO. 253
NGO-St-120
YS357/T7 3'

NM_013285.1, L05425.1, AL034379.8, U69600.1, AC007020.4, AF085279.1, I29991.1, AF176688.1, AC006200.2,
AE003829.1, NM_010393.1, NM_006574.1, NM_002824.1, AF126482.1, AF125444.1, AF059274.1, AF088905.1,
AC005515.1, AF016684.1, AL121748.6, Z72514.1, U20374.1, U47326.1, X16423.1, X16203.1, X16197.1, U07055.1,
X64053.1, X16481.1, X65748.1, X00246.1, Y13586.1, Y10211.1, M24398.1, M27134.1, M23445.1, L29190.1, M27034.1,
J00393.1, M63790.1, AC0003651 NM_010398.1, AC007281.3, AF041855.1, AF057279.1, AF082510.1, U88154.1,
U88153.1, U96752.1, U91424.1, Z68106.1, AL020997.1, AL110509.2, X16198.1, X16424.1, AB021155.1, M11284.1,
L00606.1, AW157242.1, AA902387.1, AI925558.1, AI628921.1, AW070650.1, AA401208.1, AW409935.1, AW162279.1,
AA722289.1, AW172793.1, AA126418.1, AA780182.1, AA857353.1, AW804193.1, AW156969.1, AW183614.1,
AI376281.1, AI826742.1, AA582490.1, AA446557.1, AW246802.1, AI474094.1, AA483614.1, AA934590.1, AA846248.1,
AI253092.1, AA888018.1, AW804232.1, AI699045.1, AI954511.1, AA171554.1, AI867001.1, AI760439.1, AW804255.1,
AI763044.1, AW804270.1, AI825244.1, AI671605.1, AA126000.1, AI702310.1, AA766044.1, AI798554.1, AW250835.1,
W81287.1, AW768894.1, AA635139.1, AW002316.1, AW362969.1, AW118384.1, AA493881.1, AI470650.1,
AA659293.1, AA863491.1, AA196109.1, AA831455.1, AI244063.1, AA659297.1, N32569.1, AI245761.1, AA515590.1,
AI909114.1, T27737.1, AA524198.1, AW607751.1, AI345764.1, AW301566.1, AI310849.1, AI310651.1, AW268086.1,
AI589981.1, AA056760.1, AW268169.1, AA403201.1, AL135350.1, AA614309.1, AI907635.1, AW529039.1,
AI112872.1, AI060050.1, AA546717.1, AW532741.1, AW557260.1, AV220510.1, AI646349.1, AI536459.1,
AW653179.1, AI853259.1, AV090573.1, AI058723.1, AV310274.1, AV236721.1, AV236719.1, AV167761.1,
AW111676.1, AV311465.1, AV296078.1, AV225966.1, AA646750.1, AA472792.1, AA111295.1, AC027731.2,
AL355880.2, AC023077.3, AC026348.3, AC068683.1, AC022553.2, AC023000.2, AC010058.5, AC013019.1,
AC010195.7, AC026992.2, AC027820.2, AC021884.2, AC022388.2, AC022937.3, AC019056.4, AC017422.1,
AC015232.1, AC007438.6, AC006086.7, AC006087.12, AC002490.1, AL159141.1, AC044907.2, AC022558.3,
AC044814.2, AC025036.6, AC051623.1, AC012145.3, AC021523.3, AC021296.2, AC007477.5, AC021959.4,
AC006279.6, AC015535.4, AC020585.5, AC025110.1, AC010009.4, AC016767.3, AC019749.1, AC018050.1,
AC016210.1, AC015148.1, AC009454.1, AL136090.10, AL135840.7, AL133341.9, AP001390.1, AP001120.1,
SEQ ID NO. 254
NGO-St-121
YS363/T3 5'

AF098638.1, NM_004703.1, X77723.1, X91141.1, U70777.1, D85844.1, D86066.1, AB001750.1, D88828.1, D38038.1,
Y08613.1, AF164343.1, AC000021.1, AB022176.1, AL031003.1, AC011309.4, AC002089.1, AC013454.4, AC003019.1,
U58108.1, L78833.1, AF051934.1, AL163268.2, AC000119.1, AL022476.2, S86117.1, AJ229042.1, AB018418.1,
AC010I51.3, AC024080.2, AC008444.4, AC002340.2, AE003833.1, AE003798.1, AF035218.1, AC006249.1,

TABLE 1-continued

Sequence homologies (GenBank Accession Numbers)

AC004657.1, AF027868.1, AL031661.28, AL161587.2, AL117188.1, AL049845.7, AL031431.8, AL022239.1, U22110.1,
D90899.1, Z79479.1, AB020865.1, Z34519.1, Z99114.1, AW501546.1, W28259.1, W27092.1, AW371635.1, AL042125.1,
AA611522.1, AA614931.1, AW748799.1, AA110819.1, Z28809.1, AW304131.1, M371714.1, AW450989.1, AV162434.1,
AI024379.1, M288155.1, H24233.1, H16513.1, AW371421.1, AW496353.1, R40226.1, AA208526.1, AA075857.1,
AA543909.1, AW501200.1, AW385206.1, AW760996.1, AW558606.1, AW558583.1, AW298142.1, AW294127.1,
AI874594.1, AI835959.1, AI788080.1, AV100560.1, M537352.1, AI411951.1, AI410456.1, AA858493.1, AI309599.1,
AI194657.1, AI182965.1, AI152676.1, AI144668.1, AI060676.1, AI046764.1, AA959394.1, AA940384.1, AA797665.1,
AA763173.1, AA717573.1, AA710050.1, AA709538.1, AA561671.1, AA408328.1, AA285493.1, AA270256.1,
AA241245.1, AA230889.1, AA213293.1, AA104682.1, AA104275.1, AA104274.1, AA087023.1, AA062156.1,
AA061500.1, AA031128.1, AA028486.1, AA011772.1, W63860.1, W34388.1, W18032.1, W09805.1, AW694402.1,
AW691053.1, AV213344.1, AV007100.1, AA892832.1, AA489256.1, T76002.1, AC015727.3, AC006338.3, AC007248.2,
AC007039.3, AC006990.3, AC006983.2, AC053490.1, AC006982.1, AC036236.1, AC026852.1, AC020855.2,
AC021307.3, AC010089.2, AC024353.2, AC011753.2, AC020562.1, AC013575.1, AC011900.1, AL163760.1,
SEQ ID NO. 255
NGO-St-121
YS363/T7 3'

AC004148.1, AL157499.1, AL050211.1, AC009275.5, AC008154.6, AE003690.1, AE003653.1, AC005524.1, Z47358.1,
X98238.1, AI972322.1, AA193309.1, AA528241.1, AW235706.1, AA527684.1, AI436191.1, AA890512.1, AW299850.1,
AA767452.1, AI580941.1, M056055.1, AI130923.1, AA283713.1, AI418205.1, AI056706.1, M808670.1, AW137415.1,
AI400431.1, AW295892.1, AA846649.1, AA960854.1, AI222234.1, AI084465.1, AA479888.1, AA917434.1, AA960792.1,
AA290870.1, AW089851.1, AI090024.1, AI078176.1, AA683232.1, AI023887.1, AA706411.1, AA040801.1, AI632800.1,
AI367258.1, AA693619.1, W15394.1, T03894.1, AI955173.1, AI269900.1, AA218890.1, AI669191.1, AA760918.1,
AI826582.1, AI910510.1, AW082288.1, N52967.1, Z39660.1, Z28661.1, W58520.1, AA954763.1, R50797.1, AA041239.1,
H90518.1, AI349313.1, AI301633.1, AA412174.1, AI800039.1, P26651.1, AW235792.1, AA621533.1, AA194263.1,
AI932942.1, H09347.1, M953061.1, R40788.1, AW752307.1, AA216603.1, AW351827.1, H73642.1, Z28597.1,
AW137802.1, H51737.1, N45966.1, AW576920.1, Z20686.1, Z285%.1, Z24941.1, AA425331.1, N44279.1, AA766379.1,
AI742337.1, AA426446.1, AI696486.1, Z72398.1, D20547.1, AA778438.1, AV331582.1, AW046470.1, AA472952.1,
AA120705.1, AV357525.1, AA409778.1, AC016370.4, AC026940.2, AC026455.2, AC015932.4, AC019267.3,
AC018853.3, AC009074.2, AC009201.3, AC022549.1, A0014455.1, AC017510.1, AC006491.23, AC011631.1,
AL157823.3, AP001847.1, Z92859.1,
SEQ ID NO. 256
NGO-St-122
YS1742/T3 5'

NM_005089.1, D49677.1, U51224.1, D49676.1, AC004106.1, NM_009453.1, D45205.1, NM_011663.1, S69507.1,
D26474.1, D17407.1, U92882.1, Z74476.1, AC002530.1, U80017.1, AL031767.13, AL133100.1, AL096854.5, Z99279.1,
M83200.1, AP000002.1, AK000538.1, NC_001139.1, AC005250.1, AC003074.1, AC004451.1, AC004882.2, AC007402.3,
AC009992.5, AC004947.2, AF098999.1, AL121754.18, U60414.1, U62631.1, U57971.1, AB013003.1, AB013004.1,
AP000173.1, AP000333.1, AW866867.1, AI417175.1, AW371109.1, AW137848.1, AI200960.1, N80309.1, AA845804.1,
AA320008.1, AA028127.1, AA028151.1, AA814970.1, AA814962.1, AA920561.1, AA331011.1, AW364105.1,
AI598939.1, AW144684.1, AW356771.1, AW805221.1, AI472111.1, AW345188.1, AW535394.1, AI576737.1,
AI454541.1, AI112465.1, AA601026.1, AI112441.1, AI663887.1, AA388471.1, AW383892.1, AV357914.1, AW826265.1,
AW613523.1, AW514825.1, AV331731.1, AW117909.1, AV149324.1, AV124185.1, AV036810.1, AA841469.1,
AA771282.1, AA507133.1, AA199064.1, Z74661.1, W27716.1, AV440680.1, AW671805.1, AW569275.1, AV359278.1,
AV212567.1, AW039499.1, AI989107.1, AI946720.1, AI868501.1, AV117593.1, AI763597.1, AV062802.1, AI755024.1,
AV032630.1, AI648156.1, AI594159.1, AI466310.1, AI452794.1, AI412501.1, AI381209.1, AI232722.1, AI101718.1,
AI011347.1, AI266800.1, AI114436.1, AI058893.1, AA807323.1, AA763112.1, AA709977.1, AA600133.1, AA545349.1,
AA519216.1, AA452591.1, AA424001.1, AA329479.1, AA326345.1, Z81248.1, AA078585.1, C07041.1, C06862.1,
C06853.1, H34402.1, AC008536.5, AC008461.4, AC008812.6, AC008763.4, AC017027.4, AC016287.3, AC011257.3,
AL136314.4, AC025259.4, AC068227.1, AC020985.4, AC018429.3, AC019244.2, AL139113.4, AL137004.2,
AC069141.1, AC063954.2, AC046141.3, AC007641.10, AC027960.2, AC018720.2, AC009245.8, AC027495.2,
AC025669.2, AC044808.1, AC023841.2, AC023421.2, AC026513.2, AC015916.3, AC019049.2, AC016814.3,
AC011985.3, AC018671.5, AC016503.2, AC021329.3, AC021563.1, AC011094.2, AL121983.7, AL157361.6,
AL139419.1, AP000654.1,
SEQ ID NO. 257
NGO-St-122
YS1742/T7 3'

NM_005089.1, AC004106.1, D49677.1, U51224.1, D49676.1, NM_011663.1, NM_009453.1, 569507.1, D45205.1,
D26474.1, D17407.1, AL031317.1, AL139078.2, AB026659.1, AW194326.1, AW089584.1, AI991464.1, AI828556.1,
AA430135.1, AA723697.1, AI634052.1, AW237119.1, T67521.1, AA377829.1, AW515964.1, AA569819.1, T67543.1,
AA601026.1, AA669459.1, AW609046.1, AI663908.1, AI663887.1, AI893901.1, AI636519.1, AI632192.1, H41170.1,
AC008536.5, AC008461.4, AC008451.3, AC040954.1, AC007569.8, AC027671.2, AC016823.4, AC021594.3,
AL138881.4, AP001641.1,
SEQ ID NO. 258
NGO-St-123
YS1702/T7 3'

U40705.1, AF04391.1,1, NM_003218.1, U74382.1, AF003001.1, AC006572.2, AL163204.2, NM_009352.1, U65586.1,
X93511.1, U70993.1, L63545.1, AC004484.2, AC004617.1, U47029.1, D83257.1, YI 7297.1, AC011738.4, AE003685.1,
NM_009263.1, AL033534.1, Z47809.1, S78177.1, X13986.1, X51834.1, X16151.1, J04806.1, NC_001145.1, AC004667.2,
AE003478.1, AE003432.1, AC002080.1, AC004964.2, AC007285.3, Z36238.1, Z48618.1, AL036326.1, AA467901.1,
N68057.1, AW772242.1, AI394003.1, AA135978.1, AA135764.1, AA467846.1, I76958.3, AA463246.1, AW152089.1,
F13251.1, AW088675.1, R70911.1, AW860774.1, AA468251.1, AL046407.1, AI347136.1, AA317158.1, AI524143.1,
Z45971.1, AI144010.1, AA207271.1, T63517.1, AI802125.1, AA468235.1, AI689994.1, AI680979.1, AW003979.1,
AA529658.1, R68526.1, AI125634.1, AW197488.1, AI088591.1, AA204808.1, AI989793.1, Z19923.1, AI553354.1,

TABLE 1-continued

Sequence homologies (GenBank Accession Numbers)

R25990.1, AI313657.1, AI313655.1, AW367580.1, AI653818.1, AA982217.1, AW822952.1, AW413558.1, AW413468.1, AW412565.1, AW412480.1, AW411784.1, AW261735.1, AW260247.1, AW260085.1, AW259661.1, AW240668.1, AW240555.1, AW215800.1, AW212687.1, AW209307.1, AW209207.1, AW209119.1, AW208838.1, AW113907.1, AI987812.1, AI929854.1, AI891858.1, AI875465.1, AI875197.1, AI847805.1, AI839505.1, AI802541.1, AI790405.1, AI788611.1, AV017671.1, AV001287.1, AI648742.1, AI647513.1, AI528600.1, AI325605.1, M282135.1, AI182295.1, AI132382.1, AU021551.1, AI043071.1, AI043053.1, AI042865.1, AI035296.1, AA986704.1, AA980925.1, AA839469.1, AA798241.1, AA789592.1, AA591084.1, AA563324.1, AA537448.1, AA145872.1, AA122501.1, AA073811.1, W08572.1, AL137013.3, AL050303.2, AC022893.2, AFI64115.1, AC011941.4, AC012670.2, AL162851.3, AC068925.1, AC023087.3, AC011904.2, AC024067.3, AC024095.6, AC021771.2, AC018453.3, AC015364.1, AC017348.1, AC008172.1, AC055808.2, AC011346.3, AC017014.3, AC026903.2, AC016486.4, AC012288.2, AC012602.2, AC014153.1, AL139162.3, AL009027.1,
SEQ ID NO. 259
NGO-St-124
YS033/T3 5'

AF039690.1, AFI61348.1, AC006041.2, AC004636.1, AE003598.1, AE003485.1, NM_007186.1, AC005694.3, AC005529.7, AC005527.3, AC006221.1, AC004755.1, AF049105.1, AF022655.1, AL121586.28, Z47074.1, AP000965.2, U48937.2, AE003029.1, AF163441.1, AF123008.1, AF123007.1, AF122994.1, AP092091.1, AL137686.1, Z82185.1, AL035070.3, AJ011930.1, AP001068.1, AP001067.1, M98498.1, W29097.1, AI092201.1, AA690806.1, AA155014.1, AV127431.1, AA089195.1, AI967815.1, AI865255.1, AV359357.1, AV328696.1, AV287587.1, AV313495.1, AV272703.1, AV233789.1, AV233050.1, AA143515.1, AW708128.1, AW368913.1, AV338709.1, AV332139.1, AV290604.1, AV323766.1, AV027087.1, AI240775.1, AI170252.1, AI038890.1, AW679928.1, AW584240.1, AW581584.1, AW581582.1, AW573270.1, AW518642.1, AW516804.1, AW436684.1, AW369753.1, AW341252.1, AV354655.1, AW134807.1, AI969272.1, AI949771.1, AI948870.1, AI924168.1, AI914290.1, AI892918.1, AI871649.1, AI832248.1, AI830664.1, AI824895.1, AI819076.1, AI819130.1, AL037429.1, AI796870.1, AI769675.1, AI717994.1, AI708155.1, AI700048.1, AI697939.1, AI697687.1, AI689763.1, AI660476.1, AI655335.1, AU059236.1, AI621281.1, AI394537.1, AI379706.1, AI341342.1, AI304914.1, AI301627.1, AI300957.1, AI299037.1, AI298964.1, AI292090.1, AI290292.1, AI224563.1, AI167134.1, AI146249.1, AI140672.1, AI089910.1, AI039908.1, AI016407.1, AA995707.1, AA973566.1, AA967806.1, AA938631.1, AA907234.1, AA780678.1, AA742364.1, AA682624.1, AA591111.1, AA452630.1, AA252245.1, AA252941.1, AA242923.1, AA153891.1, W65797.1, W05501.1, N70619.1, D81647.1, AC024509.2, AL355978.2, AC019168.3, AC023267.2, AC024691.2, AC009011.2, AC034307.2, AC022983.2, AC015865.1, AC013902.1, AC017166.1, AC006839.13, AL139226.14, AC035146.2, AC007640.2, AC012411.3, AC021822.3, AC013829.4, AC021670.2, AL162453.4,
SEQ ID NO. 260
NGO-St-124
YS033/T7 3'

AF039690.1, U79271.1, AL117525.1, AC009479.3, AC005358.1, AF136378.1, AC005081.2, AF045555.1, AL031650.21, AC006919.5, AC010967.2, AC008056.6, NM_012776.1, AC005386.1, NM_001619.2, U42580.2, AC007538.5, S81843.1, U08438.1, Z68282.1, AL121757.7, AL049544.4, AL031681.13, S48813.1, U39674.1, L23127.1, M34073.1, M80776.1, X61157.1, AB025 639.1, M74822.1, M87854.1, X53421.1, AI735499.1, AW028371.1, AI445418.1, AI266387.1, AI288955.1, AW193663.1, AI298467.1, AI168222.1, AI148323.1, AI140814.1, AI089322.1, AA879456.1, AA843811.1, AA829894.1, AA102109.1, AA029201.1, W72147.1, N51485.1, AI808317.1, AI033069.1, AA161465.1, AA812519.1, N64528.1, H99906.1, AA886109.1, R71679.1, AI970343.1, AA744290.1, AW021346.1, AA099913.1, AW195719.1, AI267979.1, AA083859.1, AI038590.1, N51277.1, AA883684.1, R07471.1, H98684.1, R36854.1, F25334.1, R39448.1, AA083954.1, R54092.1, H09074.1, AA346369.1, AA910762.1, AW873705.1, N21975.1, D59844.1, AW195087.1, H11525.1, AA971254.1, W77907.1, W29097.1, AW057648.1, AL041060.1, AI659852.1, AA878973.1, AW392482.1, AI057361.1, AA715235.1, F35739.1, AW427844.1, AW022199.1, AI963422.1, AA860455.1, AA026096.1, I26899.1, AI481147.1, N71178.1, AW413553.1, AW046739.1, AI529534.1, AI661769.1, AA269966.1, AI614472.1, AA026516.1, AI713205.1, AI575014.1, AI112396.1, AI073194.1, AI651890.1, AI575171.1, AA466212.1, AW181975.1, AI888595.1, AV162955.1, AI452798.1, AI167638.1, AW495689.1, AI397450.1, AW547034.1, AW479264.1, AC024079.2, AC022960.2, AL161723.3, AP001333.1, AC044855.2, AC060801.2, AC018648.2, AC068004.1, AC009623.3, AC013699.2, AC021912.3, AC018685.5, AC016675.4, AF202962.1, AL139349.16, AL132661.15, AL117190.2, AC010798.6, AC037488.2, AC036143.2, AC034212.3, AC008377.3, AC018640.1, AC009444.2, AC025803.2, AC021417.3, AC026750.2, AC024242.2, AC026809.1, AC022882.3, AC016721.4, AC024342.2, AC009923.3, AC022828.2, AC023002.1, AC011237.3, AC017078.3, AC011290.2, AL080314.29, AL163540.3, AL162632.1, AL353713.1, AL158068.4, AL159973.2, AL133501.1, AP001586.1, AP001023.1, AP000425.1,
SEQ ID NO. 261
NGO-St-124
YS173/T3 5'

AF039690.1, AF161348.1, AC006615.1, AC006041.2, AC004636.1, AB006709.1, AE003598.1, AC005070.1, AC007632.4, AC005041.2, AC006221.1, Z47074.1, U48937.2, AC007019.4, AC011751.2, AF145727.1, AF164622.1, AF163441.1, AF204231.1, AC010870.4, AC005589.1, AC008072.3, AF092091.1, AF009623.1, AC004048.1, AC004257.1, AL163300.2, AL137686.1, U88309.1, AL021492.1, Z46787.1, Z94057.1, AL035070.3, AP001819.1, MO11930.1, AP001068.1, AP001067.1, AB029041.1, AB020662.1, D84549.1, M98498.1, AI092201.1, AA155014.1, W29097.1, AW150169.1, AV127431.1, AA089195.1, AI606060.1, AI967815.1, AV359357.1, AV328696.1, AV287587.1, AV313495.1, AV272703.1, AV233789.1, AV233050.1, AA690806.1, AW708128.1, AV338709.1, AV332139.1, AV290604.1, AV323766.1, AV027087.1, AI240775.1, AI170252.1, AW679928.1, AW584240.1, AW581584.1, AW581582.1, AW369753.1, AV354655.1, AL044559.1, AL037429.1, AU059236.1, AA780678.1, D81647.1, AC024509.2, AL355978.2, AC019168.3, AC023267.2,, AC024691.2, AC018403.4, AC009011.2, AC012473.5, AC012487.3, AC006724.1, AP001523.1, AC037470.2, AC040171.2, AC009636.3, AC025660.2, AC022983.2, AC023750.1, AC015865.1, AC016040.2, AC017166.1, AL354654.1, AL138479.1,

TABLE 1-continued

Sequence homologies (GenBank Accession Numbers)

SEQ ID NO. 262
NGO-St-124
YS173/T7 3'

AF039690.1, U79271.1, AL117525.1, AF136378.1, AL031650.21, X79703.1, AC006919.5, AC008056.6, NM_0127761
NM_001619.2, AF193021.1, AC007538.5, S81843.1, AF121782.1, AF064857.1, AL163281.2, AL133283.9, U08438.1,
Z50044.1, Z68282.1, AL121757.7, AL049544.4, AL031681.13, S48813.1, U39678.1, U39674.1, I23127.1, M34073.1,
M80776.1, X61157.1, M74822.1, M87854.1, X53421.1, AI735499.1, AW028371.1, AI445418.1, AI266387.1, AI288955.1,
AW193663.1, AI298467.1, M168222.1, AI148323.1, AI140814.1, AI089322.1, AA879456.1, AA843811.1, AA829894.1,
AA102109.1, AA029201.1, W72147.1, N51485.1, AI808317.1, AI033069.1, AA161465.1, AA812519.1, N64528.1,
H99906.1, AA886109.1, R71679.1, AI970343.1, AA744290.1, AW021346.1, AA099913.1, AW195719.1, AI267979.1,
AA083859.1, AI038590.1, N51277.1, AA883684.1, R07471.1, H98684.1, R36854.1, R39448.1, F25334.1, AA083954.1,
R54092.1, H09074.1, AA346369.1, AA910762.1, AW873705.1, N21975.1, W29097.1, D59844.1, AW195087.1, H11525.1,
AA971254.1, W77907.1, AW057648.1, AL041060.1, AI659852.1, AA878973.1, AW392482.1, AI057361.1, AA715235.1,
F35739.1, AW022199.1, AW427844.1, AA860455.1, AI963422.1, AA026096.1, AI481147.1, T26899.1, AW413553.1,
AW046739.1, AI529534.1, AI661769.1, AA269966.1, N71178.1, AI614472.1, AI713205.1, AI575014.1, AI112396.1,
AI073194.1, AA026516.1, AI651890.1, AI575171.1, AA466212.1, AV162955.1, AA690806.1, AI397450.1, AC022960.2,
AP001333.1, AC044855.2, AC060801.2, AC018648.2, AC068004.1, AC013699.2, AC026224.1, AC021912.3,
AC018685.5, AF202962.1, AL139349.16, AL132661.15, AL117190.2,
SEQ ID NO. 263
NGO-St-125
YS3710/T3 5'

AF099990.1, AF068261.1, D88190.1, AC005950.1, AC001228.1, D64137.1, NM_002840.1, AF099988.1, AL137556.1,
Y19224.1, Y00815.1 NM_000076.1, AC024753.1, AE003481.1, AE003458.1, NM_002653.1, AF109719.2, AC004367.1,
AF009648.1, AL157480.1, Z83844.5, U48869.1, U22398.1, AB018791.1, NM_014961.1, AE003669.1, AF112221.1,
AC005811.10, AF082296.1, AC004466.1, AL008583.1, AK000911.1, AB020678.1, M63356.1, AC003487.1, AF047034.2,
AF071810.1, AC004797.1, U09808.1, AE003663.1, U90653.2, NM_012699.1, AC022517.1, AF071813.1, AC004876.2,
AC005259.1, L81775.1, X95703.1, X98993.1, X62681.1, AF189262.1, NM_014341.1, AF176006.3, AF192559.3,
NM_013024.1, AF189289.1, AF071815.1, NM_009453.1, NM_006460.1, AC007395.3, AF139177.1, U86410.1,
M83196.1, U40628.1, U40627.1, X00618.1, AL031107.1, J02675.1, AJ002179.1, D45205.1, D83484.1, X00254.1,
X76232.1, M63348.1, U03771.1, AF255552.1, AF168787.1, AC007774.1, AC006486.1, AJ004801.1, Z77662.1,
AL136295.2, U14656.1, AW070197.1, AI873022.1, AW575715.1, AW271726.1, AW172297.1, AW170107.1, AI524194.1,
AI652188.1, AI623209.1, N95583.1, AA283710.1, AA573499.1, AI674687.1, AA694439.1, AI760975.1, AA731091.1,
AI230984.1, AA805306.1, AA927565.1, AW369632.1, AI425458.1, AI578926.1, AI043684.1, AA851538.1, AA221745.1,
AW028244.1, AI873396.1, AI492967.1, AI192683.1, AI854240.1, AI850380.1, M575971.1, AI461919.1, AW047118.1,
AA997145.1, AI008247.1, AA409914.1, AA408939.1, AA402099.1, C11942.1, AA305260.1, AW869895.1, AI272945.1,
AI429741.1, AW595481.1, AI595277.1, AI327425.1, AA481582.1, AA061204.1, W98922.1, AV408902.1, AW696319.1,
AW677099.1, AW513114.1, AW280634.1, AW280527.1, AW243892.1, AW133917.1, AI852364.1, AI803180.1,
AI784610.1, AI671129.1, AI640998.1, AA998163.1, AA964571.1, AI159402.1, AW244421.1, AW624533.1,
AW593458.1, AW574954.1, AW149459.1, AW092856.1, AI987240.1, AI876971.1, AI356089.1, AI225774.1, AI166942.1,
AA791749.1, AA544523.1, W16147.1, W18003.1, W13961.1, N42977.1, H19168.1, AC013791.3, AC0102164
AC008470.3, AC023467.2, AL355519.2, AC025716.1, AC008350.3, AC010714.2, AC020195.1, AC008232.3,
AC006903.1, AC006727.1, AC006751.1, Z98864.1, AC008406.5, AC014744.1, AC024725.3, AC026968.2, AC021248.3,
AC014187.1, AC014191.1, AL035406.22, AC021024.3, AC009570.7, AC034220.3, AC021091.2, AC009061.8,
AC027682.2, AC011430.4, AC007732.2, AC026759.1, AC009911.9, AC010848.12, AC011707.7, AC021618.3,
AC019638.1, AC014137.1, AC014975.1, AC010024.2, AC007831.1, AL121908.11, AC024215.7, AC068810.1,
AC010648.5, AC022274.4, AC015462.5, AC022307.7, AC024047.2, AC024708.2, AC010003.5, AC009369.5,
AC011244.3, AC010703.2, AL122034.8, AL137066.5, AL354940.3, AL157708.2, AC027810.3, AC027796.3,
AC058789.9, AC026270.2, AC016631.5, AC011514.2, AC027800.2, AC067434.1, AC026167.2, AC027040.2,
AC019234.3, AC012236.3, AC009915.4, AC024159.1, AC023852.1, AC013273.2, AC020327.1, AC020433.1,
AC020525.1, AC007925.4, AC017941.1, AC018090.1, AC008228.2, AC013124.1, AC013189.1, AC013210.1,
AC014106.1, AC014400.1, AC015146.1, AC007822.3, AL031258.10, AL355153.1, AL080247.3,
SEQ ID NO. 264
NGO-St-126 combined AC067976.1, AC010763.2, AC067721.3, AC063926.3, AC026210.1, AC022240.2, AC025076.3, AP001541.1,
AP000614.3, AC009543.4, AC026325.3, AC026317.5, AC026311.4, AC025580.3, AC012112.2, AC022926.2,
AC020012.1, AC018212.1, AL137864.6, AL356371.1, AL356260.1, AC040919.1, AC044905.2, AC036192.2,
AC023648.3, AC068679.1, AC027464.2, AC021200.4, AC012512.2, AC012164.10, AC017097.2, AC013273.2,
AC012352.3, AC022183.2, AC011018.2, AC018224.1, AC015182.1, AC009742.3, AP181895.1, AF128834.1,
AL355143.4, AL354814.1, Z92852.20, AL021149.3, AP002000.1, AP001361.1, AP000786.1, AP000785.1, AL021347.1,
AI469428.1, AW004984.1, AW675448.1, AW780423.1, AW239395.1, AW651755.1, AA535069.1, AI378367.1,
AA879433.1, AA971454.1, AI394371.1, AI564549.1, AA446421.1, AW553616.1, AA928053.1, N78225.1, AI431285.1,
AA870109.1, AW674657.1, AI364000.1, AA305698.1, AA760173.1, AW674987.1, AW087890.1, N59764.1,
AW548602.1, AW881866.1, AA897396.1, AW673412.1, AW674408.1, AA056907.1, AI20201.1,1, AA213076.1,
AI047089.1, AW392852.1, M747290.1, T36030.1, AW544283.1, M131751.1, AW340239.1, T19014.1, T96204.1,
R94457.1, AA518752.1, AI115877.1, AI119061.1, AA123206.1, AI753769.1, AI787898.1, AA765346.1, AI715715.1,
AA999172.1, AA221877.1, AI460161.1, T81090.1, C03806.1, N86797.1, AW079585.1, AW672700.1, AW527002.1,
AU076916.1, AI741285.1, R00722.1, AI892500.1, R00723.1, AA644165.1, AI916149.1, AI482319.1, AI325806.1,
T81139.1, AA438060.1, AA561307.1, AI873729.1, AA561305.1, AV040805.2, AV235074.1, AV220284.1, AI614757.1,
AW275744.1, AV265274.1, AV248478.1, AV245335.1, AV263802.1, AV270362.1, AV043755.2, AV048190.1,
AV370590.1, D25791.1, AV114853.1, AV111421.1, AV256037.1, AV795876.1, AV374021.1, AV261192.1, AV320489.1,
AV252321.1, AV366822.1, AV299835.1, AV312541.1, AA450537.1, AC067976.1, AC010763.2, AC067721.3,
AC063926.3, AC026210.1, AC022240.2, AC025076.3, AP001541.1, AP000614.3, AC009543.4, AC026325.3,
AC026317.5, AC026311.4, AC025580.3, AC012112.2, AC022926.2, AC020012.1, AC018212.1, AL137864.6,
AL356371.1, AL356260.1, AC040919.1, AC044905.2, AC036192.2, AC023648.3, AC068679.1, AC027464.2,

TABLE 1-continued

Sequence homologies (GenBank Accession Numbers)

AC021200.4, AC012512.2, AC012164.10, AC017097.2, AC013273.2, AC012352.3, AC022183.2, AC011018.2,
AC018224.1, AC015182.1, AC009742.3, AF181895.1, AF128834.1, AL355143.4, AL354814.1, Z92852.20, AL021149.3,
AP002000.1, AP001361.1, AP000786.1, AP000785.1,
SEQ ID NO. 265
NGO-St-126
YS136/T3 5'

NM_003875.1, U10860.1, X87562.1, AL139077.2, AB033168.1, AC007956.5, AE003718.1, NM_0048792 AC004877.1,
AF010313.2, AC006052.5, AL035671.5, NC_001139.1, AC020580.9, AC002382.1, AC006064.9, AC005895.1, Z72999.1,
AL022328.21, AL049781.4, AL133068.1, AL133399.1, M88277.1, X59698.1, X78987.1, D90899.1, AB037724.1,
AK001986.1, AB023482.2, U03425.1, AB009050.1, AW239395.1, AW651755.1, AW672700.1, AU076916.1, AI119061.1,
AW527002.1, AI787898.1, AI115877.1, AI614757.1, AA123206.1, AA450537.1, AI892500.1, AI325806.1, AW372007.1,
AW367352.1, AI930281.1, AA561307.1, AA561305.1, AW732597.1, AW732373.1, AW248209.1, AV300605.1,
AW163311.1, AV204617.1, AI550018.1, AW699234.1, AW653532.1, AW653462.1, AW336984.1, AW163624.1,
AI929457.1, AI739490.1, AI069011.1, R58474.1, R57620.1, R46363.1, R14654.1, T38036.1, T33110.1, Z43008.1,
AC010763.2, AC026210.1, AC044905.2, AC023648.3, AC019035.5, AC018958.2, AC013273.Z AC012669.2,
AC018224.1, AC009742.3, AC012522.7, AC068285.2, AC021891.2, AC008692.4, AC010373.4, AC011116.3,
AC018696.3, AC024931.3, AC018996.3, AC009621.4, AC022213.3, AC021265.3, AC022930.2, AL133416.3,
AL137161.3, AL137855.2, AL135924.10, AL080247.3,
SEQ ID NO. 266
NGO-St-126
YS136/T7 3'

NM_003875.1, U10860.1, AC006380.2, AF006203.1, AC009396.5, Z50794.1, U21627.1, AI469428.1, AW004984.1,
AI564549.1, AW675448.1, AA535069.1, AI378367.1, AW780423.1, AA879433.1, AI394371.1, AA971454.1, AI431285.1,
AA928053.1, AW674657.1, AI364000.1, AA305698.1, AW674987.1, AW087890.1, AW673412.1, AI202011.1, N59764.1,
AW674408.1, AI741285.1, AA056907.1, AA897396.1, AW340239.1, AW553616.1, AW548602.1, AA870109.1,
AW544283.1, AI131751.1, AI753769.1, AI460161.1, AA765346.1, AI715715.1, AA999172.1, AA221877.1, N78225.1,
T81090.1, AW079585.1, R00723.1, AI747290.1, AI482319.1, AA446421.1, AI873729.1, AW275744.1, T96204.1,
AV263802.1, AV235074.1, AV248478.1, AW881866.1, D25791.1, AV245335.1, AV370590.1, AV265274.1,
AV220284.1, AV040805.2, AV114853.1, AV111421.1, R94457.1, AV261192.1, AV320489.1, AV048190.1, AV043755.2,
AV270362.1, AV256037.1, AV374021.1, AV312541.1, AV366822.1, AV352771.1, AV299835.1, AV261104.1,
AV337229.1, AV254627.1, AV257886.1, AV252321.1, AV261234.1, AV255806.1, AV380586.1, AV281906.1,
AV283090.1, AW681473.1, AV279890.1, R00722.1, AV359752.1, AA218130.1, AV351363.1, T81139.1, AW634678.1,
AW634655.1, AV263948.1, AW766970.1, AW460442.1, BB001634.1, AW198719.1, AW148282.1, AV228798.1,
AC067976.1, AC067721.3, AC024615.2, AC009550.3, AC037444.2, AC037467.2, AC027003.2, AC010679.3,
SEQ ID NO. 267
NGO-St-126
YS1613/T3 5'

NM_003875.1, U10860.1, U67598.1, U39471.1, U28733.1, M64282.1, AE003537.1, AB012242.1, AC008993.3,
AE003781.1, AC008063.2, AC005061.2, AC004605.1, AC007090.3, AE001176.1, AF067215.1, AL161532.2,
AF016678.1, Z93778.1, Z30215.1, AC002109.1, AL078621.19, AL050399.1, U42844.1, AC000I20.1, Z94044.1,
AL035447.3, AP002067.1, X60691.1, M93038.1, M14115.1, M16632.1, M59809.1, M59810.1, M59808.1, M14707.1,
AA760173.1, AI047089.1, AA518752.1, N86797.1, C03806.1, AA644165.1, T36030.1, T19014.1, AA438060.1,
AI916149.1, AA213076.1, AI795876.1, AA123206.1, AA561308.1, AA561307.1, AA561305.1, AW392852.1,
AW651755.1, AI325806.1, AI892500.1, AI878306.1, AI119061.1, R94029.1, AV346184.1, AW154885.1, AW031455.1,
AW725845.1, AW271459.1, AW201020.1, AV376365.1, AI990909.1, AV174444.1, AI353515.1, AA909030.1, I70524.1,
AC063926.3, AC067721.3, AC022240.2, AC009543.4, AC012112.2, AC022926.2, AL137864.6, AL356371.1,
AL356260.1, AC025076.3, AC027464.2, AC015773.4, AC012512.2, AC020668.4, AC012352.3, AC015182.1,
AF181895.1, AF128834.1, AP001541.1, AP000614.3,
SEQ ID NO. 268
NGO-St-126
YS1613/T7 3'

NM_003875.1, U10860.1, AC006380.2, AF134842.1, AC002127.1, NM_004849.1, AL022067.1, Y11588.1, AC004450.2,
AC009396.5, AC006145.2, AC003953.1, Z50794.1, X97212.1, AI469428.1, AW004984.1, AW675448.1, AW780423.1,
AA535069.1, AI378367.1, AA879433.1, AA971454.1, AI394371.1, AI564549.1, AA928053.1, AI431285.1, AW553616.1,
AW674657.1, AI364000.1, AA870109.1, AA305698.1, AW674987.1, AW087890.1, N59764.1, AW548602.1,
AA897396.1, AW673412.1, AA056907.1, AW674408.1, N78225.1, AI202011.1, AW544283.1, AI131751.1, AW340239.1,
AI753769.1, AI715715.1, AA765346.1, AI747290.1, AA999172.1, AA221877.1, AI460161.1, AA446421.1, T81090.1,
AW079585.1, AI741285.1, AW881866.1, T96204.1, R00723.1, R94457.1, AI482319.1, AI873729.1, AV040805.2,
AV235074.1, AV220284.1, AW275744.1, AV265274.1, AV248478.1, R00722.1, AV245335.1, AV263802.1, AV270362.1,
AV043755.2, AV048190.1, AV370590.1, D25791.1, AV114853.1, AV111421.1, AV256037.1, AV374021.1, AV261192.1,
AV320489.1, AV252321.1, AV352771.1, AV366822.1, T81139.1, AV299835.1, AV312541.1, AW681473.1, AV254627.1,
AV261104.1, AV337229.1, AV261234.1, AV257886.1, AV255806.1, AV283090.1, AV281906.1, AV279890.1,
AV380586.1, AW634678.1, AW634655.1, AV359752.1, AV351363.1, AV280423.1, AA218130.1, AV263948.1,
AW460442.1, AW766970.1, W88512.1, AW484561.1, AI705688.1, AA112455.1, N94345.1, AC067976.1, AC067721.3,
AC025580.3, AL355980.2, AL162491.3, AC044895.1, AC021200.4, AL133509.7, AL138917.3, AP001361.1,
AP000786.1, AC044809.3, AC026450.2, AC034188.2, AC025241.2, AC027415.1, AC026201.1, AC023147.3,
AC024449.2, AC022004.2, AC022219.2, AC010987.4, AL136109.3, AL139230.6, AP001828.1, AP000653.1,
AP000595.2,

TABLE 1-continued

Sequence homologies (GenBank Accession Numbers)

SEQ ID NO. 269
NGO-St-126
YS1722/T3 5'

NM_003875.1, U10860.1, AE003669.1, AE003647.1, AE003413.1, AC006574.1, U39471.1, U28733.1, M64282.1,
AF125313.1, AF10I305.1, U85195.1, Z46935.1, AE000658.1, AL136297.2, AL035091.2, AP000064.1, AB012242.1,
AC007964.3, AE003566.1, NM_004849.1, AC005061.2, AF125961.1, AC005988.1, AE001176.1, U69730.1, AL161532.2,
AL050399.1, AL133305.2, U97001.1, AL022342.6, AL022067.1, Z99127.1, Y11588.1, Z59557.1, AA446421.1,
AW392852.1, AA213076.1, 36030.1, T19014.1, AW881866.1, N78225.1, R94457.1, AI469428.1, AI916149.1, T96204.1,
AA760173.1, R00722.1, T81139.1, AI047089.1, AI747290.1, AW004984.1, AW553616.1, AA518752.1, AA870109.1,
AW675448.1, AI564549.1, AW780423.1, AA446419.1, AW548602.1, AA644165.1, AA438060.1, AI353445.1,
AA305698.1, AI378367.1, AA879433.1, AA535069.1, AW681473.1, AW127943.1, AI394371.1, AI431285.1,
AA971454.1, AW674987.1, AW674657.1, AW673412.1, AI364000.1, AI131751.1, AW544283.1, AI715715.1,
AA999172.1, AI878306.1, AI239160.1, AA221877.1, AW846110.1, AW846072.1, AV346184.1, AW826474.1,
AV376365.1, AW088646.1, AI622981.1, AI489164.1, AA909030.1, AA703095.1, AA676931.1, AA157391.1,
AA112455.1, W01474.1, N94345.1, N36362.1, AC067721.3, AC067976.1, AC063926.3, AC025076.3, AP001541.1,
AP000614.3, AC009543.4, AC026325.3, AC026317.5, AC026311.4, AC012112.2, AC020012.1, AC018212.1,
AL137864.6, AL356371.1, AC040919.1, AC068679.1, AC011172.4, AC017097.2, AC022183.2, AC011018.2,
AL355143.4, AP002000.1, AP001361.1, AP000786.1, AP000785.1, AL021347.1, AC032026.3, AC024978.3, AC024402.3,
AC024628.3, AC007777.3, AC068800.3, AC025243.3, AC041049.2, AC034110.2, AC068811.4, AC010738.3,
AC046201.2, AC025433.3, AC022124.3, AC008857.4, AC008390.6, AC016596.4, AC055724.1, AC068079.1,
AC009406.3, AC016336.3, AC025549.3, AC009420.2, AC021811.2, AC022213.3, AC016379.3, AC016563.2,
AC020963.1, AC024396.1, AC022272.2, AC016833.2, AC022864.1, AC013363.3, AC013014.1, AC012050.1,
AL138849.6, AL161641.3, AL133509.7, AL353655.2, AL355076.1, AL353623.2, AL138917.3, AP001166.1, AP000945.2,
AP000940.2,
SEQ ID NO. 270
NGO-St-126
YS377/T3 5'

NM_003875.1, U10860.1, X87562.1, AL139077.2, U67598.1, AE003718.1, AC004877.1, AC006052.5, Z93021.2,
AL035671.5, Z83313.1, AC011508.4, AC002382.1, AF199339.1, AC005083.1, AC009525.3, AL049634.8, Z19155.1,
AL163275.2, AL136167.8, AL049781.4, AL133399.1, Z83827.1, AL035447.3, X59698.1, X78987.1, D90899.1,
AP001730.1, AP001433.1, AB037724.1, AP000158.1, AP000014.2, U03425.1, AW651755.1, AW239395.1, AI115877.1,
AI119061.1, AI787898.1, AA123206.1, AW527002.1, AI892500.1, AI325806.1, AA561307.1, AA561305.1, AI614757.1,
C03806.1, AW672700.1, AA450537.1, AA561308.1, N86797.1, AW372007.1, AU076916.1, AW367352.1, AI930281.1,
AI878306.1, AI045575.1, AV300605.1, AV204617.1, AI550018.1, AW699234.1, AW653532.1, AW653462.1,
AW361093.1, AW163624.1, AV160657.1, AI069011.1, AA813333.1, AA772484.1, AA751742.1, AA227692.1, N28842.1,
R58474.1, R57620.1, R46363.1, R14654.1, 33110.1, Z43008.1, AC010763.2, AC008011.8, AC044905.2, AC046144.3,
AC023648.3, AC027464.2, AC012164.10, AC013273.2, AC012352.3, AC018224.1, AC009742.3, AF181895.1,
AF128834.1, AI354814.1,
SEQ ID NO. 271
NGO-St-127
YS263/T3 5'

NM_014753.1, D80009.1, AC024843.1, AF093673.1, AC009784.2, AF063097.1, AL031386.1, NM_007187.1,
AC006004.1, AC007007.2, AF157835.1, AC007202.2, AC005275.1, AC005833.1, AF071185.1, AC005221.1,
AL161496.2, AL031634.1, AL121754.18, AL118516.10, AL022345.2, AL050321.8, AJ238786.1, AK001557.1,
AK000979.1, AB018116.1, AI012750.1, W23168.1, AI733771.1, AA129555.1, AI906333.1, AA659526.1, AA905330.1,
AV189348.1, C65491.1, AI166512.1, AW871663.1, AW497693.1, AW463327.1, AW463204.1, AV404894.1,
AW352454.1, AW255263.1, AI954303.1, AI728334.1, AI668682.1, AI376662.1, AI090140.1, AA999519.1, AA668944.1,
AA509065.1, AA503500.1, AA427376.1, AA417429.1, N88168.1, AL023808.2, AL022344.1, AL031601.2, AC037447.2,
AC022400.4, AL135925.3, AC025039.3, AC025268.2, AC055809.2, AL136982.1, AC024946.4, AC006888.2,
AC009719.2, AC024379.2, AC027182.1, AC022939.2, AC020868.1, AC016788.4, AC024127.1, AL133383.6,
AC021024.3, AC068787.3, AC068757.2, AC023600.13, AC027645.3, AC021104.2, AC067748.3, AC027108.2,
AC023155.4, AC017090.3, AF252826.1, AC025385.2, AC027211.1, AC024073.2, AC023178.3, AC021839.3,
AC024722.2, AC021114.3, AC018443.5, AC0I7001.4, AC021761.3, AC023873.2, AC023854.2, AC010672.4,
AC022566.1, AC016042.2, AC012559.6, AF215848.1, AC007689.12, AC016158.2, AC010911.1, AC010073.1,
AL158143.2, AL158089.6, AL354975.4, AL136079.3, AL355530.1, AL354857.2, AL161775.3, AL158217.3, AL157877.5,
AP001827.1, AP000643.1, Z96803.1,
SEQ ID NO. 272
NGO-St-127
YS263/T7 3'

NM_014753.1, D80009.1, AE003451.1, AC011294.3, Z85996.1, AC007244.2, AJ271079.1, M22462.1, AE003815.1,
AE003364.1, AC004963.2, AF153352.1, AC007068.17, AE001389.1, Z78067.1, AP000419.1, L15320.1, AC007042.2,
AC006544.19, AF135026.1, AE003557.1, AE003528.1, AC003060.1, AF228703.1, U91325.1, AC004832.3, AC004876.2,
AC007368.11, AC007461.8, AC004950.2, AC005033.1, AC003065.1, AC005548.1, U21933.1, AF010237.1, AC004167.1,
AC004104.1, AC002324.1, AE001032.1, AL050342.42, Z98949.1, Z77662.1, Z50015.1, AL022315.1, AL121723.36,
AL157498.1, AL137325.1, U31447.1, AL023800.1, L19655.1, AP000475.3, M73822.1, AP001111.1, AP000023.1,
AB028621.1, D87018.1, AB029018.1, AC006481.3, AF050157.1, AL121656.2, AL022310.1, AB016885.1, AW237092.1,
AW237137.1, AI935281.1, AW467637.1, M963620.1, AI650475.1, AI628080.1, AA927690.1, AI338027.1, AI590556.1,
AA604575.1, AA203521.1, AI281023.1, AI609068.1, AI689223.1, AW058425.1, AA483799.1, AW473973.1,
AA278635.1, AW083923.1, AA915891.1, AA766731.1, AI984984.1, AW803966.1, AI281118.1, AI131367.1, AI537394.1,
AI278563.1, AA159506.1, AI304815.3, AI033401.1, AI049943.1, AW004875.1, AA047286.1, T87897.1, AW029023.1,
AA480172.1, AI285145.1, AA252803.1, AA261816.1, AI867812.1, AA554061.1, AI753409.1, W81534.1, AI015310.1,
AA099000.1, T87990.1, AI184520.1, R00576.1, AI824434.1, AL047806.1, W81533.1, I79535.1, AA047147.1, R33795.1,
AA864952.1, AI149983.1, R00680.1, M810930.1, AW263579.1, AI866914.1, T97738.1, AW796065.1, AA278634.1,

TABLE 1-continued

Sequence homologies (GenBank Accession Numbers)

AI802574.1, AI651401.1, AW004034.1, AW175987.1, AI005967.1, AA793158.1, H62063.1, AA571438.1, AI376279.1,
AA623849.1, AW194865.1, AW428271.1, AW175972.1, AA616918.1, AW205363.1, AA762572.1, AA223495.1,
H61156.1, AA421215.1, AA411512.1, AA405999.1, AA293345.1, AA555719.1, T97844.1, AA914529.1, AA726890.1,
AA262513.1, AA058106.1, AW910545.1, AW416674.1, AW416666.1, AI406390.1, AA421216.1, AA411513.1,
AA399425.1, AW523356.1, AL022344.1, AL023808.2, AC036220.3, AC023099.2, AC022264.2, AC011753.3,
AC023723.2, AC014984.1, AC009785.4, AC011191.3, AC013532.2, AC025638.3, AC010033.7, AC068739.2,
AC034244.3, AC008481.6, AC027517.2, AC036185.1, AC015925.3, AC015724.4, AC019168.3, AC017420.1,
AC013378.3, AC007107.1, AC025011.2, AC022061.3, AC012431.6, AC015990.5, AC058333.2, AC020904.5,
AC011543.3, AC011491.4, AC018880.2, AC021111.3, AC024638.2, AC022297.7, AC017059.2, AF215848.1,
AL158846.3, AL139404.2, AL139110.2, AL121828.8, AL161618.5, AP001102.2, AP001005.1, AP000813.1,
SEQ ID NO. 273
NGO-St-127
YS324/T7 3'

NM_014753.1, D80009.1, AE003451.1, Z85996.1, AC007244.2, AI271079.1, M22462.1, AC004963.2, AF153352.1,
AC007068.17, Z78067.1, Z83844.5, AL078477.5, AP000419.1, L15320.1, AC007042.2, AC006544.19, AF135026.1,
AC027657.1, AE003557.1, AF228703.1, AC004832.3, AC004876.2, AC005003.2, AC006371.2, AC008078.11,
AC008010.10, AC007368.11, AF134488.1, AC004961.2, AC007461.8, AC006432.15, AC004950.2, AC002082.1,
AC005033.1, AC003065.1, U21933.1, AF010237.1, AC004167.1, AC004104.1, AC002324.1, AE001032.1, Z98949.1,
Z77662.1, Z50015.1, U93037.1, AL022315.1, AL121723.36, AL031767.13, AL049838.3, AL157498.1, AL137325.1,
U31447.1, AL023800.1, AL031665.18, L19655.1, AB040962.1, M73822.1, AP001111.1, AP000023.1, AB028621.1,
A8005049.1, AB029018.1, NM_001702.1, NM_013146.1, AL121656.2, AL022310.1, U18419.1, X54171.1, AB005297.1,
M963620.1, AW467637.1, AW237092.1, AW237137.1, AI628080.1, AI935281.1, M650475.1, AI338027.1, AA604575.1,
AA927690.1, AI609068.1, AI590556.1, AI281023.1, AW058425.1, AI689223.1, AA203521.1, AA483799.1, AW473973.1,
AA278635.1, AA915891.1, AW083923.1, AA766731.1, AI984984.1, AI281118.1, AI131367.1, AI537394.1, AI278563.1,
AA159506.1, AI304815.1, AI049943.1, AI033401.1, AW004875.1, AI285145.1, AA047286.1, AW803966.1,
AW029023.1, T87897.1, AA480172.1, AA252803.1, AA261816.1, AI753409.1, AI867812.1, W81534.1, AA554061.1,
AI015310.1, AA099000.1, AI184520.1, R00576.1, AI824434.1, T87990.1, AA047147.1, M866914.1, AA864952.1,
R33795.1, AI149983.1, AI810930.1, I79535.1, AI802574.1, AW263579.1, T97738.1, R00680.1, W81533.1, AW004034.1,
AL047806.1, AW194865.1, AI376279.1, AI651401.1, H62063.1, AW205363.1, AW428271.1, H61156.1, AA421215.1,
AA411512.1, AA405999.1, AA293345.1, AA223495.1, AW796065.1, AA278634.1, T97844.1, AA421216.1, AA411513.1,
AA399425.1, AA455122.1, AA402812.1, AA402916.1, AA402630.1, AW523356.1, AW522183.1, AW469155.1,
AW469154.1, AW469148.1, AI406390.1, AW910545.1, AI005967.1, AA623849.1, AA408648.1, W77672.1, AA914529.1,
AA793158.1, AA571438.1, AL022344.1, AL023808.2, AC036220.3, AC023099.2, AC022264.2, AC011753.3,
AC023723.2, AC014984.1, AC022146.3, AC009785.4, AC011191.3, AC013532.2, AC010033.7, AC068739.2,
AC034244.3, AC008481.6, AC036185.1, AC025473.2, AC015925.3, AC015724.4, AC023857.2, AC025011.2,
AC022061.3, AC012431.6, AC015990.5, AC009757.8, AC018634.2, AC058333.2, AC040949.2, AC021893.10,
AC012640.4, AC011491.4, AC026040.3, AC021111.3, AC025749.2, AC009899.5, AC013391.3, AC018679.5,
AC022297.7, AC023325.2, AC022908.2, AC017059.2, AC011329.5, AC014174.1, AC010826.2, AC011098.1,
AL158846.3, AL139404.2, AL137004.3, AL137793.2, AL133402.10, AL121828.8, AL161618.5, AL161739.2,
AL161448.3, AP001936.1, AP001102.2, AC009857.2, AC026077.3, AC022258.3, AC021240.3, AC023451.2,
AC013609.2, AC014418.1, AC007118.1, AC003115.1, AC003118.1, AL138846.3,
SEQ ID NO. 274
NGO-St-127
YS345/T7 3'

NM_014753.1, D80009.1, AE003451.1, AC011294.3, Z85996.1, AC007244.2, AI271079.1, M22462.1, AE003815.1,
AE003418.1, AC004963.2, AF153352.1, AC007068.17, AE001389.1, Z78067.1, AL132792.2, AP000419.1, L15320.1,
AC007042.2, AC006544.19, AF135026.1, AC027657.1, AE003557.1, AE003528.1, AC003060.1, AF228703.1, U91325.1,
AC004832.3, AC008078.11, AC007368.11, AF134488.1, AC007461.8, AC004950.2, AC002082.1, AC005033.1,
AC003065.1, AC005548.1, U21933.1, AF010237.1, AC004167.1, AC004104.1, AC002324.1, AE001032.1, AL050342.42,
Z98949.1, Z77662.1, Z50015.1, AL022315.1, AL121723.36, AL031767.13, AL157498.1, AL137325.1, U31447.1,
AL023800.1, L19655.1, AB040962.1, AP000475.3, M73822.1, AP00R 111.1, AP000023.1, AB028621.1, AB005049.1,
AB029018.1, AC006481.3, AF050157.1, AL121656.2, AL022310.1, AB016885.1, AW237092.1, AW237137.1,
AI935281.1, AI628080.1, AW467637.1, AI650475.1, AI963620.1, AI338027.1, AA927690.1, AA604575.1, AI281023.1,
AI590556.1, AA203521.1, AI609068.1, AI689223.1, AW058425.1, AA483799.1, AW473973.1, AA766731.1,
AA278635.1, AW083923.1, AA915891.1, AI984984.1, AI281118.1, AI131367.1, AI537394.1, AI278563.1, AA159506.1,
AI304815.1, AW803966.1, AI033401.1, AI049943.1, AW004875.1, AA047286.1, T87897.1, AW029023.1, AA480172.1,
AI285145.1, AA252803.1, AA261816.1, M867812.1, AA554061.1, AI753409.1, W81534.1, AI015310.1, AA099000.1,
AI184520.1, R00576.1, I787990.1, AI824434.1, AA047147.1, R33795.1, AA864952.1, I79535.1, AI149983.1, AI810930.1,
AI866914.1, AW263579.1, I797738.1, W81533.1, R00680.1, AL047806.1, AI802574.1, AI651401.1, AW004034.1,
H62063.1, AI376279.1, AW194865.1, AW796065.1, AW428271.1, AA278634.1, AW205363.1, AI278563.1, H61156.1,
AA421215.1, AA411512.1, AA405999.1, AA293345.1, T97844.1, AW175987.1, AI005967.1, AA793158.1, AA623849.1,
AA914529.1, AA571438.1, AI406390.1, AA421216.1, AA411513.1, AA399425.1, AA455122.1, AA402812.1,
AA402916.1, AA402630.1, AW910545.1, AW469155.1, AW469154.1, AW469148.1, AW523356.1, AW175972.1,
AW522183.1, AL022344.1, AL023808.2, AC036220.3, AC023099.2, AC022264.2, AC011753.3, AC023723.2,
AC014984.1, AC009785.4, AC011191.3, AC013532.2, AC025638.3, AC010033.7, AC068739.2, AC008481.6,
AC027517.2, AC036185.1, AC015925.3, AC015724.4, AC019168.3, AC017420.1, AC020219.1, AC013378.3,
AC007107.1, AC025011.2, AC022061.3, AC012431.6, AC015990.5, AC058333.2, AC036174.2, AC020904.5,
AC011543.3, AC011491.4, AC026658.2, AC021111.3, AC022297.7, AC012664.3, AC017059.2, AF215848.1,
AC011098.1, AL158846.3, AL139404.2, AL139110.2, AL121828.8, AL161618.5, AL157699.2, AP001936.1, AP001005.1,
AP000813.1, AC024232.2, AC008060.3, AC026077.3, AC021240.3, AC022518.2, AC023451.2, AC013609.2,
AC014418.1, AC006738.1, AC003118.1, AL138846.3, AL136371.2,

TABLE 1-continued

Sequence homologies (GenBank Accession Numbers)

SEQ ID NO. 275
NGO-St-128
YS1714/T3 5'

D83327.1, D83077.1, D84296.1, D84295.1, D84294.1, NM_0094411 AB008516.1, AJ001866.1, AL163273.2,
AP001728.1, AP001429.1, AP000150.1, D83253.1, AP000009.2, AP000I51.1, AF099914.1, AL132992.2, AL132977.1,
AC006017.2, AC010170.3, U67510.1, AL021684.1, X60399.1, D64005.1, AB018108.1, AC008865.3, AE003786.1,
AE003627.1, AE003085.1, AF198444.1, AC006367.3, AC005666.1, AC004053.1, Z82058.1, Z82278.1, Z19156.1,
AL034408.2, AL049643.12, X69058.1, AB030387.1, X16640.1, AW510696.1, AW130658.1, AI955031.1, AI365371.1,
AW272845.1, AI655615.1, AI651380.1, N75792.1, N22573.1, R49365.1, I765109.1, AA733976.1, AL044710.1,
AA968229.1, AI834826.1, AI956999.1, AI935572.1, AA226473.1, F11111.1, AI462554.1, AV373371.1, AV349801.1,
AV348118.1, AA226308.1, BB006439.1, AV172670.1, AV348357.1, AA387528.1, AA822624.1, N45260.1, AV331075.1,
AI580340.1, I183303.1, AA612013.1, AA054190.1, AI508671.1, AW691731.1, AW690698.1, AW637870.1, AW446918.1,
AI662108.1, AI528491.1, AU033435.1, N50729.1, AC020718.3, AC009801.3, AC026848.2, AF206725.1, AC025470.3,
AC026616.2, AC011632.3, AL161426.3, AC068145.2, AC009685.3, AC024156.2, AC021196.3, AC011260.4,
AC015861.5, AC021000.3, AC007728.1, AC021983.1, AP001378.1, AC025412.3, AC068288.2, AC008905.5,
AC026474.3, AC009131.4, AC034282.2, AC067842.1, AC015971.3, AC011726.3, AC009671.3, AC024525.2,
AC019359.3, AC025009.2, AC013450.4, AC009746.10, AC018685.6, AC016129.10, AC010667.9, AC023015.2,
AC020798.2, AC025338.1, AC020183.1, AC012419.2, AL356317.1, AL133326.8, AL355392.2, AL356017.1,
AL161745.5, AL162505.3, AL133241.3, AL117187.2, AL117331.1, AL031011.20, Z98859.1,
SEQ ID NO. 276
NGO-St-128
YS1714/T7 3'

D83077.1, D84296.1, D84295.1, D84294.1, D83327.1, AL163273.2, AP001728.1, AP001429.1, AP000151.1, D83253.1,
AP000009.2, NM_009441.1, AB008516.1, AC007023.3, AL022395.2, AF037454.1, NM_008395.1, AC010283.5,
AC007198.6, AC020717.3, AC005310.2, AC007955.4, AF090190.1, AC005008.2, AC005034.1, AF131865.1,
AF064058.1, AF032967.1, U42213.1, AC005571.1, AC005224.1, AC005304.1, AL049832.2, L28005.1, AB017653.1,
AP000463.1, AB025607.1, AB023656.1, AB011163.1, AI336910.1, AI337091.1, AW665117.1, AI885338.1, AL042620.1,
AA722789.1, AA743347.1, AA887657.1, AI678227.1, AI318428.1, AW772752.1, AA515769.1, AW341881.1,
AA554904.1, AA112857.1, AA083921.1, AW803145.1, AI568131.1, AW237011.1, AI657054.1, AI653679.1,
AL040434.1, AW612699.1, AA470557.1, AA662541.1, AA470510.1, AA502576.1, AA852823.1, AW629888.1, R13859.1,
AL039361.2, AA021274.1, AW352731.1, AA722688.1, AI003122.1, AW488299.1, AA669782.1, H31610.1, AW525528.1,
AA997915.1, AW743421.1, AI646427.1, AI145984.1, W50656.1, AW108450.1, AA794421.1, AI019132.1, H06584.1,
AI666638.1, AA270792.1, AA417656.1, AW296426.1, AI838089.1, AW466371.1, AA308558.1, AI839685.1,
AA048256.1, AV170771.1, AV136593.1, AI846084.1, Z42452.1, AI412296.1, AV278830.1, AV319373.1, AV332268.1,
AV327734.1, AV259825.1, AV157173.1, AV378262.1, AV341338.1, AW245310.1, AW822071.1, AV326279.1,
AA155001.1, AI812831.1, AA543759.1, AW923586.1, AW921274.1, AW908406.1, AW760328.1, AW349130.1,
AW310768.1, AW258283.1, AW202374.1, M957871.1, AI931902.1, AI790763.1, AA940042.1, AA839623.1,
AA758570.1, AA739484.1, AA739481.1, AA387131.1, AA110637.1, AC012032.11, AL139409.3, AL356276.1,
AC019259.3, AC025596.1, AC021573.4, AC068169.1, AL161450.4, AC026096.2, AC021484.3, AC012528.2,
AC024127.1, AC019061.3, AL139134.4, AL355876.2, AC025076.3, AC037466.3, AC046139.4, AC012506.4,
AC025541.4, AC051657.2, AC010256.3, AC018539.4, AC026993.2, AC009654.3, AC025060.3, AC026080.2,
AC023271.2, AC019312.3, AC026058.2, AC021552.2, AC012571.3, AC025075.2, AC011170.3, AC009699.6,
AC021042.3, AC026842.1, AC021914.3, AC013779.3, AC021694.2, AC008418.1, AC023168.6, AC023000.2,
AC013266.3, AC011239.2, AC007373.1, AL136124.8, AL356216.1, AL356055.1, AL137126.4, AL162375.4,
AL161640.6, AL160234.1, AP001541.1, AP000945.2, AP000940.2, AP000914.2, AP000614.3,
SEQ ID NO. 277
NGO-St-128
YS223/T3 5'
D83077.1, D84296.1, D84295.1, D84294.1, D83327.1, NM_0094411 AB008516.1, A3001866.1, AL163273.2,
AP001728.1, AP001429.1, AP000150.1, D83253.1, AP000009.2, AL132992.2, AL132977.1, AC010170.3, U67510.1,
X60399.1, D64005.1, AC010643.5, AF210726.1, AE003786.1, AE003085.1, AF198444.1, AC006367.3, AF083501.2,
AC006360.2, AC005666.1, AF074613.1, AF043470.1, Z82278.1, AL034408.2, AL049643.12, AB011549.2, AB030387.1,
Y11275.1, AW510696.1, AW130658.1, AI651380.1, AI655615.1, AI955031.1, AI365371.1, AW272845.1, AL044710.1,
AA733976.1, AI956999.1, N75792.1, AA968229.1, N22573.1, AI935572.1, R49365.1, T65109.1, AA387528.1,
AI834826.1, AA226308.1, N45260 1, AW386774.1, AA226473.1, AI580340.1, AI508671.1, AI462554.1, P11111.1,
AV373371.1, AV348118.1, AV349801.1, AV348357.1, AW637870.1, AW446918.1, AI662108.1, AI528491.1,
AC009801.3, AC026848.2, AF206725.1, AC068145.2, AC068274.2, AC009685.3, AC021196.3, AC012246.3,
AC015861.5, AC021000.3, AC022895.2, AC010218.4, AC008680.3, AC008665.3, AC008473.3, AC067842.1,
AC048393.1, AC019359.3, AC033746.1, AC025009.2, AC013450.4, AC009746.10, AC018685.6, AC016129.10,
AC010667.9, AC023015.2, AL356317.1, AL355392.2, AL162505.3, AL117331.1, AL031011.20,
SEQ ID NO. 278
NGO-St-128
YS223/T7 3'

D83077.1, D84296.1, D84295.1, D84294.1, D83327.1, AL163273.2, AP001728.1, AP001429.1, AP000I51.1, D83253.1,
AP000009.2, NM_009441.1, AB008516.1, AC007023.3, AL022395.2, AP001432.1, AP000010.2, AC010283.5,
AF224.027.1, AC004463.2, U68519.1, AF062065.1, AF062064.1, AF062063.1, AF062062.1, AC007198.6, AF015414.1,
AF015413.1, U21135.1, Z81117.1, L21456.1, L21357.1, L21465.1, L214.61.1, L21458.1, L21452.1, L21448.1, L21446.1,
L21444.1, L21439.1, L21429.1, L21425.1, L21424.1, L21371.1, L21364.1, L21360.1, L21354.1, L21351.1, L24161.1,
L21330.1, L21340.1, L21329.1, L21327.1, AC020717.3, AF224041.1, AC005008.2, AF062041.1, AF062040.1,
AF032967.1, AF014360.1, AF014357.1, AF014290.1, AF014286.1, U31582.1, AF015396.1, AF015395.1, AF015394.1,
AC005571.1, AC005224.1, AF043433.1, AL022147.3, Z99114.1, U79857.1, AL049832.2, AL132975.1, AJ252870.1,
AL132870.2, U32149.1, U32148.1, U53784.1, Z70723.1, D84371.1, AP000383.1, AB007855.1, AI336910.1, AI337091.1,
AW665117.1, AI885338.1, AL042620.1, AA722789.1, AA743347.1, AA887657.1, AI678227.1, AI318428.1,
AW772752.1, AA515769.1, AW341881.1, AA554904.1, AA112857.1, AA083921.1, AW612699.1, AW803145.1,

TABLE 1-continued

Sequence homologies (GenBank Accession Numbers)

AI568131.1, AL040434.1, AW237011.1, AI657054.1, AI653679.1, AA470557.1, AA662541.1, AA470510.1, AA502576.1, AA852823.1, AW629888.1, R13859.1, AL039361.2, AA021274.1, AW352731.1, AA722688.1, AW488299.1, AA669782.1, H31610.1, AI003122.1, AW525528.1, AA997915.1, AW743421.1, AI646427.1, AI145984.1, W50656.1, AW108450.1, AA794421.1, AW466371.1, AW296426.1, AI019132.1, AA308558.1, H06584.1, AI666638.1, AA270792.1, AA417656.1, AI838089.1, AI839685.1, AA048256.1, AV170771.1, AV136593.1, AI846084.1, AI412296.1, Z42452.1, AV278830.1, AV319373.1, AW822071.1, AV332268.1, AV327734.1, AV259825.1, AV157173.1, AV378262.1, AV341338.1, AW245310.1, AV326279.1, AA155001.1, AI812831.1, AA386895.1, AA114796.1, AA038564.1, AW770946.1, AW384624.1, AW384613.1, AW384600.1, AW373107.1, AW373096.1, AW373083.1, AW372722.1, AW372709.1, AW372706.1, AW372705.1, AI986424.1, AI968847.1, AI889183.1, AI796812.1, AV142455.1, AI681420.1, AI681378.1, AI279046.1, R80871.1, R36112.1, AC012032.11, AC012528.2, AL139409.3, AL356276.1, AL139134.4, AL355876.2, AC019259.3, AC025596.1, AC035146.2, AC025777.3, AC008784.5, AC021573.4, AC068169.1, AC023488.5, AL161450.4, AC069119.1, AC026096.2, AC011669.3, AC021484.3, AC021552.2, AC011853.3, AC019269.3, AL354892.3, AL354715.2,
SEQ ID NO. 279
NGO-St-128
YS394/T7 3'

D83077.1, D84296.1, D84295.1, D84294.1, D83327.1, AL163273.2, AP001728.1, AP001429.1, AP000151.1, D83253.1, AP000009.2, NM_009441.1, AB008516.1, AC007023.3, AL022395.2, AP001432.1, AP0000.1, 0.2, AC010283.5, AF224027.1, AC004463.2, U68519.1, AF062065.1, AF062064.1, AF062063.1, AF062062.1, AC007198.6, AF015414.1, AF015413.1, U21135.1, Z81117.1, L21456.1, L21357.1, L21465.1, L21461.1, L21458.1, L21452.1, L21448.1, L21446.1, L21444.1, L21439.1, L21429.1, L21425.1, L21424.1, L21371.1, L21364.1, L21360.1, L21354.1, L21351.1, L24161.1, L21340.1, L21330.1, L21329.1, L21327.1, AF224041.1, AC007955.4, AC005008.2, AF064058.1, AF032967.1, AF014360.1, AF014357.1, AF014343.1, AF014290.1, AF014286.1, U31582.1, AC005224.1, AC005304.1, AF020713.1, AF043433.1, AL022147.3, U79857.1, AL049832.2, AL132975.1, AL132870.2, U53784.1, L28005.1, Z70723.1, D84371.1, AI336910.1, AI337091.1, AW665117.1, AI885338.1, AL042620.1, AA722789.1, AA743347.1, AA887657.1, AI318428.1, AI678227.1, AW772752.1, AA515769.1, AW341881.1, AA554904.1, AA112857.1, AA083921.1, AW803145.1, AI568131.1, AW237011.1, AI657054.1, AI653679.1, AW612699.1, AL040434.1, AA662541.1, AA470557.1, AA470510.1, AA502576.1, AA852823.1, AW629888.1, R13859.1, AA021274.1, AL039361.2, AW352731.1, AA722688.1, AW488299.1, AA669782.1, H31610.1, AI003122.1, AW525528.1, AA997915.1, AW743421.1, AI646427.1, AI145984.1, W50656.1, AW108450.1, AA794421.1, AI019132.1, H06584.1, AI666638.1, AA270792.1, AW466371.1, AW296426.1, AA417656.1, AI838089.1, AA308558.1, AI839685.1, AA048256.1, AV170771.1, AV136593.1, AI846084.1, Z42452.1, AV278830.1, AI412296.1, AV319373.1, AV332268.1, AV327734.1, AV259825.1, AV157173.1, AV378262.1, AV341338.1, AW245310.1, AW822071.1, AV326279.1, AW425970.1, AA155001.1, AI812831.1, AI968847.1, AI889183.1, AV142455.1, AW923586.1, AW908406.1, AW760328.1, AW310768.1, AW202374.1, AI957871.1, AI931902.1, AI790763.1, AA940042.1, AA839623.1, AA739484.1, AA739481.1, AA110637.1, AC012032.11, AC012528.2, AL139409.3, AL356276.1, AL139134.4, AL355876.2, AC019259.3, AC025596.1, AC035146.2, AC025777.3, AC008784.5, AC021573.4, AC068169.1, AC023488.5, AL161450.4, AC069119.1, AC026469.3, AC021484.3, AC011853.3, AL354715.2, AC037466.3, AC024462.3, AC046167.2, AC046139.4, AC026328.3, AC026307.7, AC023236.8, AC051657.2, AC026709.2, AC026426.2, AC026418.2, AC025289.2, AC018539.4, AC040967.1, AC023271.3, AC019312.3, AC026058.2, AC012571.3, AC025075.2, AC011170.3, AC026842.1, AC021178.3, AC021914.3, AC021694.2, AC008801.1, AC008418.1, AC023388.2, AC021185.2, AC023502.3, AC013266.3, AC007373.1, AC002419.1, AL136124.8, AL161640.6, AL162251.3, AL353637.1, AP001887.1, AP001362.1, AP000940.2, AP000925.2,
SEQ ID NO. 280
NGO-St-129
YS1639/T3 5'

NM_004999.1, AB002387.1, U90236.1, Z35331.1 NM_008662.1, U49739.1, AF017303.1, AL096862.18, AF146793.2, AE003650.1, AE003436.1, AE003415.1, AL161595.2, AL078620.2, AL023494.12, AL096821.2 NC_001146.1, AC020912.4, AE003764.1, AC002524.1, AF221108.1, NM_0124151 AF112481.1, AF118397.1, AC006236.1, AF084206.1, AL009050.9, AL032632.1, AL109759.3, AI251914.1, X13464.1, X03975.1, Z71468.1, M14045.1, D37977.1, AW629832.1, AA129385.1, AA028987.1, AA577227.1, AW300529.1, AW316711.1, AI863551.1, AI829419.1, AI366126.1, AI310303.1, AA910369.1, AA523580.1, AA522566.1, AI698448.1, AW235712.1, AA889126.1, AW741450.1, AW663829.1, AI747845.1, AW660315.1, AI093634.1, AA790620.1, AW696022.1, AW601223.1, AI413054.1, AA037700.1, AW831515.1, AI392575.1, AI820852.1, AI820850.1, M792698.1, AI792696.1, AI466405.1, AI252501.1, AI252429.1, AA880900.1, AA696342.1, C80997.1, C70576.1, AA542732.1, AL136093.4, AC016868.4, AC021058.7, AC036192.2, AC007365.2, AC061984.2, AC018880.2, AC021861.3, AC018545.4, AC062006.2, AC011374.4, A0011406.2, AC009544.4, AC026565.2, AC016859.2, AC017680.1, AC014098.1, AC007515.1, AL096873.2, AP001924.1, AP001384.1, AP001359.1, AP001163.1, AP000666.1, AP000674.1, AP000305.1, AC024019.3, AC022898.4, AC024035.3, AC009511.12, AC027644.4, AC007780.2, AC020897.5, AC067776.1, AC058782.1, AC018508.4, AC019309.3, AC025687.2, AC020989.5, AC013547.2, AC021008.1, AC020767.1, AC018878.1, AC013527.2, AC015353.1, AC012474.1, AL355972.3, AL139002.4, AL121828.8, AL139814.5, AL355312.3, AL354743.1, AL162852.3, AP001167.1, AP000942.2,
SEQ ID NO. 281
NGO-St-129
YS1639/T7 3'

NM_004999.1, AB002387.1, AC000117.1, AC006050.1, AE001131.1, AC005494.1, AC003068.1, AL161585.2, AL035521.1, AL163227.2, AC000374.1, Z98748.1, AP001115.1, AC005529.7, AC005617.2, AF172282.1, AC000025.2, AC004539.1, AC003080.1, AF058919.2, AC008261.3, AC004682.1, AE001579.1, AC005527.3, AC002991.1, AC003682.1, L06196.1, AF036692.1, AL161545.2, AL161472.2, Z99281.1, Z97342.2, AL022393.1, AL035661.16, AL109837.21, Z35331.1, AW772270.1, AI971254.1, AW242758.1, AW772647.1, AW168128.1, AA129322.1, AW450254.1, AI208776.1, AW613386.1, AW172995.1, AW513273.1, AW073777.1, AI921929.1, AW452837.1, AW450587.1, AI911506.1, AA625890.1, AI925526.1, AI991532.1, AW473956.1, AA166906.1, AI318048.1, AW448948.1, AI304536.1, AW451044.1, AW451217.1, AA429372.1, AI061190.1, N63006.1, AW614329.1, N39073.1, AI357971.1, AW449081.1, N49974.1, H15162.1, AA493764.1, AA632762.1, AA503650.1, AW072577.1, H88721.1,

TABLE 1-continued

Sequence homologies (GenBank Accession Numbers)

H88672.1, N62772.1, R37296.1, AA365146.1, AA492569.1, W01757.1, D62451.1, AA482738.1, N52751.1, AI373764.1, AA235474.1, AI631867.1, AI740513.1, AA330423.1, AW169179.1, AW195663.1, AI537958.1, AI767492.1, AI654090.1, AA620412.1, AA861190.1, AI659277.1, AA025688.1, AI375865.1, AI928490.1, AI651240.1, AA846667.1, AA161244.1, AA136973.1, AA114997.1, AW594496.1, AW573252.1, AV305797.1, AW149932.1, AV221167.1, AW085043.1, AW048157.1, AI871868.1, AI870057.1, AI859823.1, AI689778.1, AI678876.1, AI678873.1, AI669925.1, AV024912.1, AI550341.1, AI537625.1, AI350956.1, AI278232.1, AI187925.1, AI160733.1, AA822328.1, AA742262.1, AA422443.1, AA217420.1, AL136093.4, AC068777.3, AC063951.3, AC026784.2, AC024037.2, AL021152.1, AC055882.3, AC024304.3, AC013756.3, AC026223.3, AC020732.3, AC025666.2, AC025801.2, AC021466.2, AC018666.4, AC011840.3, AC013411.2, AC015783.2, AC002317.1, AL118519.20, AL161736.5, AL139215.4, AL033520.15, AL354827.1, AL354815.1, AP000915.2,
SEQ ID NO. 282
NGO-St-129
YS1772/T3 5'

U90236.1, Z35331.1 NM_004999.1, AB002387.1, NM_008662.1, U49739.1, AF017303.1, AL096862.18, AE003650.1, AE003436.1, AE003415.1, AL161595.2, AL078620.2, NC_001146.1, AE003764.1, AC018833.3, AF221108.1, AJ251914.3, X13464.1, X03975.1, Z71468.1, M14045.1, D37977.1, X78287.1, X78286.1, AW629832.1, AA129385.1, AA577227.1, AA028987.1, AW300529.1, AA889126.1, AA037701.1, AI093634.1, AA790620.1, AW660335.3, AW449252.1, AI747845.1, AW741450.1, AI413054.1, AW831515.1, AW663829.1, AW594845.1, AJ392575.1, AW316711.1, AW235712.1, AI863551.1, AI829419.1, AI698448.1, AI366126.1, AI310303.1, AA910369.1, AA696342.1, AA542732.1, AA523580.1, AA522566.1, AL136093:4, AC021058.7, AC061984.2, AC018880.2, AC021861.3, AC017680.1, AC014098.1, AC008577.4, AC009070.5, AC058782.1, AC032032.1, AC02.5687.2, AC012269.2, AC026206.1, AC013547.2, AC022011.2, AC018835.3, AC023575.2, AC022381.1, AC018878.1, AC013398.2, A0013527.2, AC015353.1, AL355972.3, AL139002.4, AL139814.5, AL354743.1, AL162852.3, AP001087.2, AP001272.1,
SEQ ID NO. 283
NGO-St-129
YS1772/T7 3'

NM_004999.1, AB002387.1, AL161585.2, AL035521.1, AC018833.3, AL161536.2, AL049608.1, AL078604.10, U60176.1, AC005494.1, AC000374.1, Z98748.1, AC003080.1, AC007390.3, AC004069.1, AF036692.1, Z68227.1, AW772270.1, AI971254.1, AW772647.1, AW242758.1, AA129322.1, AW450254.1, AI208776.1, AW613386.1, AW513273.1, AI921929.1, AW073777.1, AW172995.1, AW452837.1, AW450587.1, M911506.1, AA625890.1, AI925526.1, AA166906.1, AI991532.1, AW473956.1, AW448948.1, AI304536.1, AI318048.1, AW451044.1, AW451217.1, N63006.1, AA429372.1, N39073.1, N49974.1, AI061190.1, HI5162.1, AW614329.1, AW449081.1, AI357971.1, AA632762.1, AA493764.1, H88672.1, AA503650.1, H88721.1, R37296.1, AA365146.1, AW072577.1, N62772.1, W01757.3, AA492569.1, D62451.1, AA482738.1, AI373764.1, AA235474.1, N52751.1, AI631867.1, M740513.1, AA330423.1, AW169179.1, AW195663.1, AI537958.1, AI767492.1, AI654090.1, AA620412.1, AA861190.1, AI659277.1, AA822328.1, AI790656.1, AI528811.1, AA718487.1, AA070821.1, AI013854.1, AA025688.1, AI006104.1, AA087822.1, AW153153.1, AW573252.1, AWIS 3175.1, AW085043.1, AW073863.1, AI700842.1, AI501875.1, AI187925.1, AI160733.1, AI026889.1, AA907037.1, AA120798.1, AL136093.4, AC020732.3, AL161450.4, AC068777.3, AC063951.3, AC022918.2, AL136990.14, AC024086.3, AC037486.2, AC025666.2, AC013411.2, AL354827.1, AP001448.1, AC021173.3, AC026702.3, AC009095.5, AC015707.3, AC026526.2, AC024476.2, AC0I3727.3,
SEQ ID NO. 284
NGO-St-129
YS1781/T7 3'

NM_004999.1, AB002387.1, AL161585.2, AL035521.1, AC018833.3, AL049608.1, AL078604.10, AF077341.1, AF132734.1, AC006050.1, AE001131.1, U60176.1, AC005494.1, AC003068.1, AC000374.1, Z72521.1, Z98748.1, AP001115.1, AC005617.2, AC003080.1, AC004069.1, AF036692.1, Z68227.1, AI971254.1, AW772270.1, AW242758.1, AW772647.1, AA129322.1, AW168128.1, AW450254.1, AI208776.1, AW613386.1, AW513273.1, AI921929.1, AW073777.1, AW172995.1, AW452837.1, AW450587.1, AI911506.1, AA625890.1, AI925526.1, AA166906.1, AI991532.1, AW473956.1, AW448948.1, AI304536.1, AI318048.1, AW451044.1, AW451217.1, N63006.1, AA429372.1, N39073.1, N49974.1, AI061190.1, HI5162.1, AW614329.1, AW449081.1, AI357971.1, AA632762.1, AA493764.1, H88672.1, AA503650.1, H88721.1, W01757.1, R37296.1, AA365146.1, AW072577.1, N62772.1, AA492569.1, D62451.1, AA482738.1, AI373764.1, N52751.1, AA235474.1, AI631867.1, AI740513.1, AA330423.1, AW169179.1, AW195663.1, AI537958.1, AI767492.1, AI654090.1, AA620412.1, AA861190.1, AI659277.1, AA822328.1, AI790656.1, AI528811.1, AA718487.1, AA070821.1, AI013854.1, AA025688.1, AI375865.1, M181759.1, AI006104.1, AA087822.1, AI153153.1, AI501875.1, AL136093.4, AC020732.3, AC022938.3, AC068777.3, AC063951.3, AC026784.2, AC018914.3, AC022918.2, AL136990.14, AL356054.2, AL354827.1, AC013A01.2, AC026702.3, AC015707.3, AC024673.2, AC026526.2, AC024476.2, AC013727.3, AL109660.3,
SEQ ID NO. 285
NGO-St-130
YS111/T3 5'

NM_003981.1, U07707.1, Z29064.1, NM_007943.1, L21768.1, L14298.1, AC008269.3, AF229843.1, AC004527.2, AC006557.2, AL162295.1, AL163259.2, AL163205.2, AP001714.1, AP001660.1, AP001634.1, AP000180.1, AP000272.1, AP000104.1, AC005824.2, AE003551.1, AF173983.1, AC002449.1, AF091848.1, AF067807.1, U24215.1, AL133376.6, AL033521.2, X56494.1, D21071.1, AL041882.1, C17654.1, AW368006.1, AA140007.1, AI557588.1, AA349569.1, AA839181.1, AW891551.1, AU079083.1, AV105710.1, AV041867.2, AV011556.1, AV010206.1, AV441258.1, AW562154.1, AW288397.1, AW221715.1, AV383554.1, AL043683.1, AL043682.1, AI774525.1, AI486675.1, AA907496.1, AA728511.1, AA570698.1, AA041001.1, R65462.1, Z34628.1, AC048367.2, AL138904.2, AL354990.1, AC068561.1, AC065048.1, AC062150.1, AC058723.1, AC035761.1, AC024413.3, AC012403.5, AC016964.5, AC022169.2, AC024287.3, AC027418.2, AC016498.4, AC024433.2, AL356266.3, AL157813.3, AL354698.2, AP001004.2, AP001130.1, AC009179.15, AC009386.6, AC024905.7, AC023600.13, AC024523.2, AC025446.3, AC011537.6, AC036127.2, AC067715.1, AC066596.1, AC040168.1, AC020779.3, AC018827.4, AC009659.3,

TABLE 1-continued

Sequence homologies (GenBank Accession Numbers)

AC016890.4, AC022475.2, AC011266.3, AC022978.3, AC016853.4, AC007495.3, AC010043.4, AC018976.2,
AC022048.1, AC020151.1, AL161660.6, AL133318.4, AL137779.1, AP000895.2, AP001578.1,
SEQ ID NO. 286
NGO-St-130
YS111/T7 3'

NM_001981.1, AF052132.1, Z29064.1, U07707.1, AP119858.1, AC007504.3, AF235098.1, AF191069.1, AC003092.1,
AF096876.1, AL163252.2, AL115814.1, AP001707.1, AC007376.8, AL021811.1, Z69729.1, AC002113.1, AL031767.13,
M22886.1, AC010143.3, AC010971.3, AF002223.1, AF063866.1, AC003665.1, AC005808.1, AL035079.14, AL163232.2,
X71844.1, AP001687.1, AP000459.3, AL043535.1, AA781358.1, AI692447.1, N32153.1, AI453034.1, AI813894.1,
AA115267.1, AI288222.1, N25318.1, AA534309.1, AA115291.1, AI718641.1, AI978915.1, AI208237.1, AW169456.1,
AI275885.1, AW769406.1, AI693511.1, AA886343.1, AA150461.1, N49086.1, AA825660.1, AW075886.1, AA813360.1,
AW614630.1, AI520942.1, AA534862.1, Z44586.1, AA164418.1, AA702296.1, AA485200.1, N66885.1, M920898.1,
AW087764.1, N78949.1, R68155.1, N25787.1, AW813048.1, R62156.1, T10010.1, AA478744.1, AI810955.1, F10989.1,
AA748186.1, T28758.1, H13536.1, AA644498.1, AW769677.1, AI472645.1, AA385221.1, AI472603.1, AW188171.1,
W17317.1, H13535.1, AA585349.1, P.59914.1, AA300847.1, AA251517.1, F03176.1, AW050401.1, AA485087.1,
AI267611.1, AW366454.1, L25018.1, D19928.1, Z46052.1, AA251530.1, R63487.1, X85627.1, AI060900.1, AA833154.1,
AA119303.1, AV361642.1, C80702.1, AV251200.1, AW053510.1, AA630896.1, W02559.1, N48143.1, N38997.1,
AW804902.1, AW776207.1, AW775801.1, AW362615.1, AV368479.1, AI452571.1, AI309292.1, AA845594.1,
AA505330.1, AA287832.1, AA287578.1, D48726.1, AC048367.2, AC055751.2, AC020941.3, AC017093.2, AC025170.3,
AC008488.6, AC019332.3, AC026475.3, AC068066.1, AC015876.3, AC011112.3, AC018392.3, AL354712.2,
AL354760.1, AC048389.3, AC068130.2, AC024164.2, AC004898.2, AC027226.2, AC058798.1, AC011152.4,
AC010104.2, AL139125.3, AL133282.13, AL035554.1, AP001590.1,
SEQ ID NO. 287
NGO-St-130
YS383/T3 5'

NM_001981.1, U07707.1, Z29064.1, NM_007943.1, L21768.1, NM_002396.1, Z95117.1, AP002054.1, U00021.1,
M55905.1, AE003677.1, NM_007944.1, AC004862.1, AF111169.2, AC007543.4, AF131768.1, AC005758.1, AC004476.1,
Z35601.1, AL133299.2, AL096802.11, U29156.1, AB027020.1, AI936583.1, AA837424.1, AW340591.1, AA832056.1,
AI66332.3,1, AA642291.1, AL043493.1, AII51900.1, AA637559.1, AA877097.1, AA140007.1, AI584949.1, AW503469.1,
AI979367.1, AW372581.1, AU051615.1, AA625121.1, AA490194.1, AA442710.1, AA229914.1, AA229604.1, I70290.1,
AW765795.1, AV406101.1, AW186947.1, AI324049.1, C44114.1, P.54352.1, P.52338.1, F06891.1, P05583.1, T34448.1,
Z43889.1, AL138904.2, AL354990.1, AC026989.2, AC026390.1, AC022373.1, AL157785.3, AL162716.4, AL355332.1,
AC040919.1, AC046143.3, AC009078.4, AC021477.3, AL136170.3, AL139022.1, AP001845.1, AC037471.3,
AC024404.3, AC046166.2, AC012212.4, AC067723.2, AC024891.8, AC025243.3, AC005883.9, AC068054.2,
AC068389.1, AC026821.2, AC021585.3, AC023102.2, AC025339.1, AC016044.4, AC008094.4, AC021901.2,
AC021342.2, AC022837.1, AC020679.2, AC014595.1, AL136121.5, AL356133.2, AL355176.1, AP001542.1,
AL008872.1,
SEQ ID NO. 288
NGO-St-130
YS383/T7 3'

NM_001981.1, AF052132.1, Z29064.1, U07707.1, AF119858.1, AC007504.3, AF235098.1, AF191069.1, AC003092.1,
AF096876.1, AL163252.2, AL115814.1, AP001707.1, AC007376.8, AL021811.1, Z69729.1, AC002113.1, AL031767.13,
M22886.1, AC010143.3, AC010971.3, AC002479.1, AF002223.1, AF063866.1, AC003665.1, AC005808.1, AL035079.14,
AL163232.2, AL035458.35, X71844.1, AP001687.1, AP000459.3, AL043535.1, AA781358.1, AI692447.1, N32153.1,
AI453034.1, AI813894.1, AA115267.1, AI288222.1, N25318.1, AA534309.1, AA115291.1, AI718641.1, AI978915.1,
AI208237.1, AW169456.1, AI275885.1, AW769406.1, AI693511.1, AA886343.1, AA150461.1, N49086.1, AA825660.1,
AW075886.1, AA813360.1, AW614630.1, AI520942.1, AA534862.1, Z44586.1, AA164418.1, AA702296.1, AI920898.1,
AA485200.1, N66885.1, AW087764.1, N78949.1, P.68155.1, N25787.1,P.62156.1, T10010.1, AA478744.1, AI810955.1,
P10989.1, AA748186.1, L28758.1, H13536.1, AA644498.1, AW769677.1, AI472645.1, AA385221.1, M472603.1,
P59914.1, AA585349.1, AA300847.1, AA251517.1, AA485087.1, AW050401.1, F03176.1, AI267611.1, AW188171.1,
W17317.1, H13535.1, AW813048.1, AW366454.1, L25018.1, D19928.1, AA251530.1, X85627.1, AI060900.1,
AA833154.1, AA119303.1, AV361642.1, C80702.1, AV251200.1, AW053510.1, AA630896.1, W02559.1, N48143.1,
N38997.1, AW776207.1, AW775801.1, AW362615.1, AV368479.1, AW154919.1, AI868315.1, AI452571.1, AI401460.1,
AA845594.1, AA550576.1, AA505330.1, AA287832.1, AA287578.1, AC048367.2, AC020941.3, AC017093.2,
AC025170.3, AC008488.6, AC008948.5, AC019332.3, AC026475.3, AC015876.3, AC011112.3, AC018392.3,
AL354712.2, AL354760.1, AC068130.2, AC024164.2, AC004898.2, AC027226.2, AC011152.4, AC010104.2,
AL139125.3, AL133282.13, AP000793.1,
SEQ ID NO. 289
NGO-St-131
YS161/T3 5'

AB002318.1, NM_011602.1, X56123.1, AF177198.1, NM_0062891 AF078828.1, AB028950.1, AF178534.1,
AC009044.3, AE003535.1, AF224669.1, U41384.1, X59601.1, Z66108.1, Z66107.1, NM_016559.1, AC020610.6,
AE003745.1, AC002044.1, NM011027.1, AC005145.1, AC005544.1, U51243.1, AL080195.1, AL021918.1, AB032593.1,
AB032592.1, Z57921.1, AJ009823.1, AI751285.1, AW900719.1, AA452483.1, AA387755.1, AW336094.1, W17774.1,
AA474115.1, AA718262.1, AI593159.1, AA657201.1, AA615519.1, AI331130.1, R17242.1, AW437322.1, AW654277.1,
AW336729.1, AA015516.1, AA013971.1, R54389.1, AW640826.1, AW403043.1, AL042809.1, AL047970.1, AI343291.1,
D31413.1, T27372.1, T06850.1, AI691500.1, AW137249.1, AI980726.1, AI387487.1, AA748793.1, AA737559.1,
AC026030.2, AC068233.1, AL133410.11, AC009122.5, AC011056.3, AC024491.4, AC009696.5, AC018797.3,
AC026049.2, AC024629.1, AC015146.1, AP002018.1,

TABLE 1-continued

Sequence homologies (GenBank Accession Numbers)

SEQ ID NO. 290
NGO-St-131
YS161/T7 3'

AB002318.1, AF085910.1, AL137080.2, NM_0167611 AC005825.3, AF221104.1, AF221103.1, AF221102.1,
AF110520.1, AC003958.1, AL031276.1, AL008627.1, D49544.1, AI823644.1, AW629480.1, AI751284.1, AA290619.1,
AA290618.1, AW136798.1, AW195082.1, AI566119.1, AI866810.1, AI307663.1, AI417845.1, AW242353.1, AI479172.1,
AI311003.1, AI522054.1, AI952372.1, R99633.1, AI249792.1, AI366767.1, AW469603.1, AA854194.1, AA582699.1,
AI380822.1, AW303332.1, R99089.1, AW902895.1, AW136171.1, AW902834.1, AI985231.1, T16297.1, AI985222.1,
T17377.1, AA291006.1, T32600.1, AA291005.1, AW902806.1, AI142264.1, W22495.1, L20064.1, AW898163.1,
AW251506.1, AA998450.1, AI072764.1, AI551526.1, AI787438.1, AI465290.1, AA967834.1, AA718676.1, AA039087.1,
AA511363.1, AV252009.1, AV272145.1, D80367.1, D80366.1, D80352.1, D80351.1, D80339.1, D80331.1, D80330.1,
D80314.1, D80261.1, D80254.1, D80253.1, D80252.1, D80251.1, D59773.1, D59717.1, AI705776.1, AV175623.1,
D80293.1, D59809.1, AV249990.1, AW488444.1, AW389528.1, AW218598.1, AI507221.1, C85503.1, AA709996.1,
W83532.1, AC026030.2, AC016814.4, AC022910.2,

SEQ ID NO. 291
NGO-St-131
YS101/T3 5'

AB002318.1, NM_011602.1, X56123.1, AF177198.1, NM_0062891 AF078828.1, AB028950.1, AF065739.1,
AF178534.1, AC005145.1, AC009044.3, AF224669.1, I141384.1, X59601.1, Z66108.1, Z66107.1 NM_016559.1,
AC020610.6, NM_011027.1, AC005544.1, U51243.1, AL080195.1, AL021918.1, AB032593.1, AB032592.1, Z57921.1,
AJ009823.1, AI751285.1, AW900719.1, AA452483.1, AA387755.1, AW336094.1, W17774.1, AA474115.1, AA718262.1,
AI593159.1, AA657201.1, AA615519.1, M331130.1, AW437322.1, R17242.1, AW654277.1, AW336729.1, R54389.1,
AW640826.1, AA015516.1, AA013971.1, T06850.1, AW403043.1, AL042809.1, AL047970.1, AI343291.1, D31413.1,
T27372.1, AW137249.1, AI980726.1, AA748793.1, AA737559.1, AC026030.2, AC068233.1, AC009L22.5, AL133410.11,
AC024491.4, AC009696.5, AC018797.3, AC026049.2, AC024629.1, AP002018.1, AC026959.3, AC025148.3,
AC007653.4, AC012337.3, AC009772.4, AC021650.9, AC011827.3, AC064839.3, AC010074.6, AC013614.4,
AC013733.3, AC013405.1, AC021095.1, AC020569.1, AC008076.8, AL355819.2, AL117336.18, AP001007.1,

SEQ ID NO. 292
NGO-St-131
YS101/T7 3')

AB002318.1, AF085910.1, AF011399.1, AF011398.1, AL137080.2, NM_016761.1, AC005825.3, AF221104.1,
AF221103.1, AF221102.1, AF110520.1, AC003958.1, AL031276.1, AL157416.1, AL138642.1, AL008627.1, D49544.1,
AI823644.1, AW629480.1, M751284.1, AA290619.1, AA290618.1, AW136798.1, AW195082.1, AI566119.1,
AI866810.1, AI307663.1, AI417845.1, AW242353.1, AI479172.1, AI311003.1, AI522054.1, AI952372.1, R99633.1,
AI249792.1, AI366767.1, AW4.69603.1, AA854194.1, AA582699.1, AW303332.1, R99089.1, AW136171.1, AI380822.1,
AW902895.1, AW902834.1, AI985231.1, T16297.1, AI985222.1, T17377.1, AA291006.1, T32600.1, AA291005.1,
AW902806.1, AI142264.1, AW898163.1, W22495.1, L20064.1, AWl51506.1, AA998450.1, AI072764.1, AA718676.1,
AI851526.1, AI787438.1, AI465290.1, AA967834.1, AA039087.1, AA511363.1, AV252009.1, AV272145.1, M705776.1,
D80367.1, D80366.1, D80352.1, D80351.1, D80339.1, D80331.1, D80330.1, D80314.1, D80261.1, D80254.1, D80253.1,
D80252.1, D80251.1, D59773.1, D59717.1, D80293.1, D59809.1, AV175623.1, AV249990.1, AA370498.1, AW488444.1,
AW389528.1, AW218598.1, AI507221.1, AA960722.1, AA960721.1, C85503.1, AA709996.1, W83532.1, L38220.1,
AC026030.2, AC016814.4, AC022910.2,

SEQ ID NO. 293
NGO-St-132
YS011/T3 5'

NM_000346.1, AC007461.8, S74506.1, Z46629.1, AF029696.1, AF006571.1, U12533.1, AB012236.1, AB035888.1,
AB035887.1, AF106572.1, AB006448.1, D83256.1, NM_006941.1, AF006501.4, AL031587.3, AJ001183.1, AF191325.1,
AF164104.1, AF226675.1, Z99757.12, AF047389.1, AF047043.1, AF017182.1, U66141.1, U66105.1, AJ001029.1,
AE002049.1, AL135162.1, AW701461.1, AW323770.1, AE232045.1, AA220077.1, T18789.1, AW924151.1,
AW747248.1, AW746893.1, AW746873.1, AW746213.1, AW681012.1, AW680640.1, AW677948.1, AW677800.1,
AW672276.1, AW672019.1, AW665912.1, AW471059.1, AW384568.1, AW384558.1, AW384516.1, AW384461.1,
AW371943.1, AW286733.2, AW406345.1, AW321606.1, AW298118.1, AW290875.1, AW289095.1, AW245072.1,
AW161855.1, AW161352.1, AW103014.1, AW007471.1, AI885013.1, AL035821.1, AI682325.1, AI539787.1,
AI497991.1, AI410380.1, AI351117.1, AI350368.1, AI338712.1, AI335760.1, AI286186.1, AI266340.1, AI186949.1,
AI167245.1, AI144319.1, AI134312.1, M062232.1, AA973886.1, AA906673.1, AA904015.1, AA873306.1, AA836977.1,
AA688139.1, AA634800.1, AA630304.1, AA592961.1, AA472666.1, AA449553.1, AA449122.1, AA443810.1,
AA314988.1, AA287892.1, AA243383.1, W57682.1, T49849.1, AC040983.1, AC009041.5, AC012004.3,

SEQ ID NO. 294
NGO-St-132
YS1637/T3 5'

NM_000346.1, Z46629.1, AF029696.1, AB012236.1, UL2533.1, AC007461.8, S74505.1, AF106572.1, AF265207.1,
AF061784.1, NM_006941.1, AJ001183.1, 574504.1, AB035887.1, AF226675.1, AF006501.4, AL031587.3, S74506.1,
U66141.1, AI001029.1, AF047389.1, AF047043.1, AF017182.1, AF006571.1, Z18958.1, X79250.1, AF164104.1,
AB035888.1, Z99757.12, AF152356.2, AJ245601.1, AB006448.1, AF191325.1, Z18957.1, Z18959.1, D83256.1,
U70441.1, NM_011441.1, D49474.1, D49473.1, L29085.1, NM_005986.1, AX001335.1, Y13436.1, NM_007084.1,
AF107044.1, AB033888.1, X65664.1, U31967.1, NM_011443.1, NM_009233.1, NM_009234.1, AF009414.1,
AX001334.1, AX001333.1, X96997.1, X94127.1, X94126.1, AB011802.1, L29086.1, NM_003107.1, NM_009236.1,
L35032.1, X70683.1, AF116571.1, NM_0092381 NM_005986.1, AF098915.1, X70298.1, Z31560.1, AB014474.1,
L07335.1, S69429.1 NM_006942.1, AC007421.12, U12532.1, D50603.1, AB006867.1, AF193760.2, L12010.1,
AJ004858.1, M86315.1, AB026622.1, AE003776.1, AJ251580.1, AJ001730.1, NM_011446.1, NM_009237.1, U12467.1,
X94125.1, AB023419.1, AB011103.1, M86335.1, X73038.1, AF001047.1, L12022.1, L12020.1, X65660.1, L12013.1,
M86313.1, AI594348.1, AA616534.1, AL120408.1, AW321606.1, AW153579.1, AW184648.1, AV116901.1,
AW343046.1, AV120409.1, AW231213.1, AW227743.1, AW210917.1, AW513608.1, AW152310.1, AI935610.1,

TABLE 1-continued

Sequence homologies (GenBank Accession Numbers)

AI821650.1, AI758881.1, AI743736.1, AI743707.1, AI739667.1, AI732705.1, AI635063.1, AI073502.1, AA260278.1,
AI765094.1, AI087935.1, AW048216.1, AA434433.1, AA427400.1, AA405793.1, AW434258.1, AW045442.1,
AI574719.1, AII37262.1, AI136910.1, AA799800.1, AA959594.1, AI009328.1, AA411418.1, AW533591.1, AW533022.1,
AW532784.1, AW526351.1, AI716553.1, AI029515.1, AI029109.1, AA956282.1, AA956131.1, AA924900.1,
AA924896.1, AA875101.1, AI145897.1, AI136894.1, AI112078.1, AI102567.1, AA943207.1, AW244680.1, AI828016.1,
AI817673.1, M240186.1, AW766057.1, AW615144.1, AW532037.1, AW414006.1, AW235281.1, AW131791.1,
AW131705.1, AW071909.1, AW0551511, AW044044.1, AW028031.1, AW005368.1, AI990431.1, AI971611.1,
AI631443.1, M611652.1, AI571299.1, AI566261.1, AI480221.1, AI423139.1, AI421743.1, AI421119.1, AI418146.1,
AI373018.1, AI364349.1, AI356682.1, AI327463.1, AI292258.1, AI199308.1, MI51028.1, AI146406.1, AI146367.1,
AI137787.1, AI097136.1, AI096977.1, AI094794.1, AI056908.1, AI052267.1, AI717565.1, AA405899.1, AC009041.5,
AC012004.3, AF215846.1, AL355803.2, AL137061.2, AL136179.1,1, AL117346.16, AC024914.17, AC020788.4,
AC015652.6, AC008220.4, AC007975.6, AC008318.6, AC012822.1, AC020509.1, AC055113.1, AL137016.10,
AZ024915.10, AC058787.7, AC024069.15, AC007588.3, AC017264.1, AL121747.21, AC068951.1, AC011649.3,
A0026244.2, AC021051.3, AC027243.2, AC040983.1, AC027700.1, AL162584.3, AC022980.3, AC016156.7,
AC068986.3, AC022499.5, AC026376.7, AC011544.5, AC008569.5, AC021881.2, AC022532.2, AC022917.3,
AC023096.1, AC022606.2, AC005528.25, AC010665.4, AC010575.3, AC023011.1, AC010892.3, AC019870.1,
AC013906.1, AC014152.1, AC014782.1, AC009485.2, AL139246.4, AL034405.13, AL159992.3,
SEQ ID NO. 295
NGO-St-132
YS1637/T7 3'

NM_000346.1, AC007461.8, S74506.1, Z46629.1, AF029696.1, AC007070.4, U61951.2, AB023041.1, AB006448.1,
AC022521.4, AC007196.4, A0005169.2, AE003780.1, AC012392.1, AF162444.1, AC006240.1, AL161548.2,
AL161502.2, NC_001142.1, AC004669.2, AC004411.2, AC002329.2, AC018363.6, AC008134.3, AC007259.4,
AC005508.1, AC004562.1, AF058914.1, AC002539.1, AL163814.1, AL163812.1, AL161561.2, AL049655.2,
AL049171.1, AL022023.1, AL021637.2, Z35596.1, AL078637.1, AL132960.2, AL132970.2, AL132965.1, AL049538.8,
U39674.1, AP001313.1, Z20656.1, AP000367.1, AP000371.1, AW005563.1, AA576678.1, AI934455.1, AI382146.1,
AA527295.1, AI870355.1, AJ380233.1, AI681309.1, AI299871.1, AA913619.1, AW087477.1, AA912521.1, AA778589.1,
AI453423.1, AW360836.1, AA331097.1, H90100.1, AA469143.1, AA420856.1, AW075227.1, AA884178.1, AA420456.1,
AA657762.1, AI348085.1, AA333065.1, AW888412.1, AW142661.1, M985948.1, AA400739.1, AA955408.1,
AI008321.1, AW213674.1, AI852411.1, AI548994.1, W24710.1, AW360293.1, AW323128.1, AV021074.1, AW897800.1,
AI599999.1, AV281945.1, AV220920.1, AV144700.1, AV008800.1, AV233902.1, AA469215.1, AV360627.1,
AV165338.1, AV220098.1, BB004489.1, AV349732.1, AV303226.1, AW228243.1, AW360802.1, AI504553.1,
AV280305.1, BB003834.1, AV305178.1, C15879.1, AV163514.1, AW381053.1, AV305177.1, AV318841.1,
AW829173.1, AW361282.1, AV248007.1, R30640.1, AW900425.1, AW892801.1, AW776398.1, AW697226.1,
AW690623.1, AW586197.1, AW586064.1, AW559610.1, AW267726.1, AW218488.1, AU061986.1, AI164072.1,
AI162251.1, AA825782.1, AA411689.1, H63328.1, T48235.1, AV424751.1, AC013323.5, AC007194.1, AC025309.2,
AC006755.1, AC024521.3, AC013645.3, AC011065.4, A0024527.3, AC010190.7, AC024104.4, AC011491.4,
AC026623.2, AC021142.4, AC034285.1, AC025724.1, AC015854.3, AC021507.2, AC008258.3, AL078597.4,
AL163642.1, AL021576.1,
SEQ ID NO. 296
NGO-St-133
YS102/T3 5'

NM_014820.1, AB018262.1, Z19158.1, AP000007.1, AF102137.1, Z80789.1, AB030817.1, L14331.1, AC00440.17,
AC004606.1, AL031012.1, AP001425.1, AB025414.1, AC016752.2, AE003801.1, AE003726.1, AE003616.1,
AE003485.1, AE003420.1, AF127577.2, AC015450.3, AC008040.7, AC006596.2, AC006050.1, AL035331.1,
AL078611.1, AL163243.2, Z71182.1, AP001698.1, Z79997.1, AP000208.1, AP000247.1, AP000130.1, AW468485.1,
W76094.1, AA449405.1, AW230655.1, AA313460.1, AI325788.1, AI892481.1, AA116789.1, AA076346.1, AA373986.1,
AV145606.1, AW227769.1, AW320879.1, AI535287.1, Z19251.1, AW765531.1, AW281101.1, AA985348.1,
AW656932.1, AW481973.1, AW410280.1, AW356980.1, AW336895.1, AW200321.1, AW050865.1, AI834977.1,
AL048825.1, AI646136.1, AI478830.1, AA345311.1, AA278482.1, AA203592.1, R10075.1, I99341.1, T81329.1,
AC015462.5, AC023782.2, AC025607.3, AC018351.8, AC068119.1, AC026858.2, AC016229.3, AC012437.3,
AL138879.3, AP001901.1, AC036213.3, AC010464.4, AC026644.2, AC011615.3, AC008293.1, AL354734.3,
AL353707.1, AL162311.1, AL157757.1, AC012413.4, AC023891.7, AC026770.3, AC011960.3, AC027067.2,
AC015595.3, AC017094.5, AC007521.11, AC015996.2, AC012972.1, AL157905.3, AL354800.3,
SEQ ID NO. 297
NGO-St-133
YS102/T7 3'

NM_014820.1, AB018262.1, AF010516.1, AC005406.2, Z70268.1, AC009044.3, AE003547.1, NM_006021.1, Z74035.1,
X95549.1, AL022722.1, AL109925.11, A3243368.2, Z70688.1, Y15228.1, AP000382.1, AE003736.1, AL049612.11,
AI769448.1, AI581514.1, AW471382.1, AI671783.1, AW044465.1, AI795924.1, AW009918.1, AW167186.1, AI278004.1,
N49863.1, AW083882.1, AI283007.1, AI833063.1, AI478170.1, AI078346.1, AA707693.1, AI770160.1, AI126207.1,
AW513624.1, N59383.1, H11342.1, AI679546.1, D60203.1, AW102995.1, AA047406.1, N67748.1, AI373915.1,
AA937689.1, AA535637.1, AW770695.1, AA088722.1, AI278065.1, AW470297.1, AI984753.1, AI281086.1, AI088753.1,
N50512.1, N78439.1, AI089934.1, N50443.1, R75994.1, AI418032.1, AW069428.1, H28047.1, AA722233.1, AA934810.1,
AW194761.1, AI679985.1, N70890.1, R82859.1, AW576214.1, R82647.1, R60689.1, AI383079.1, AW603760.1,
R40078.1, H92752.1, H39632.1, AW388643.1, R44445.1, AA320578.1, R92461.1, AW118280.1, D55592.1, AA857398.1,
AA579529.1, R82696.1, D52213.1, AA152134.1, C14917.1, N47394.1, AA369996.1, N47395.1, AA150127.1,
AI863820.1, AL079976.2, AA047526.1, AW545304.1, AW213944.1, AI844034.1, AI225307.1, AA175289.1,
AW741826.1, AW324264.1, AW228128.1, AI849427.1, AI265537.1, AA175781.1, M600081.1, AI111343.1,
AV331675.1, AW254554.1, AW253791.1, AI714131.1, AI029154.1, AI171980.1, AV115523.1, AV340409.1,
AV227184.1, AW914053.1, AC015462.5, AC023782.2, AC044821.2, AC013713.4, AC021761.3, AC021241.3,
AL355341.3, AL157875.4, AL049756.16, AC025190.4, AC016797.4, AC024935.8, AC008595.4, AC025060.3,
AC023784.3, AC010907.3, AC022253.2, AC017109.2, AC018889.1, AL355378.1, AL118557.1,

TABLE 1-continued

Sequence homologies (GenBank Accession Numbers)

SEQ ID NO. 298
NGO-St-133
YS1783/T3 5'

NM_014820.1, AB018262.1, Z19158.1, AP000007.1, AF102137.1, AE001690.1, Z80789.1, AB030817.1, AB025414.1,
AE003713.1, AC004606.1, AL009175.1, AL139077.2, AL031012.1, AC007359.2, AC016752.2, AC003040.2,
AF248484.1, AE003801.1, AE003616.1, AC007505.4, AE002280.1, AF127577.2, AF208226.1, AC007682.2, AC008175.2,
AC015450.3, AC006481.3, AC012394.3, AC008040.7, AF166527.1, AC006463.3, AC006949.8, AC006578.5,
AC006596.2, U00670.1, AC004293.1, AC005261.1, AC004473.1, AE001065.1, AL035536.1, Z82266.1, Z78065.1,
AL078611.1, AL163255.2, AL163243.2, AL163207.2, S38096.1, AL138657.1, AL132957.1, AL021069.1, Z71182.1,
U07798.1, AP001710.1, AP001698.1, AP001601.1, Z79997.1, AP000208.1, AP000247.1, X71802.1, AP000130.1,
M95516.1, AW468485.1, W76094.1, AA449405.1, AW230655.1, AA313460.1, AI325788.1, AI892481.1, AA076346.1,
AA116789.1, AA373986.1, AV145606.1, AW227769.1, AW320879.1, AI535287.1, Z19251.1, AA155457.1, AW765531.1,
AW281101.1, AI430671.1, AA985348.1, W33868.1, AW656932.1, AW481973.1, AW410280.1, AW356980.1,
AW336895.1, AW200321.1, AW050865.1, AL048825.1, AI478830.1, AA345311.1, AA278482.1, AA203592.1,
W44281.1, R10075.1, T99341.1, T81329.1,
SEQ ID NO. 299
NGO-St-134 combined;

NM_003611.1, Y16355.1, Y15164.1, AC003037.1, AC010682.2, AC006991.2, AC016707.2, AC008175.2, AC007379.2,
AC009947.2, AF121351.1, AE003417.1, AC005039.1, AF117269.1, AF077408.1, U09819.1, AL161498.2, AF016655.1,
AL050231.2, Z99121.1, X71360.1, AP002039.1, NC_001144.1, AC009411.2, AC010498.4, AF140536.1, AE003805.1,
AE003690.1, AE003542.1, NM_002062.1, AC009514.2, AC006026.2, AC006065.3, AC005839.1, U44051.1, U85195.1,
U01156.1, AC004289.1, AC005179.1, AC004475.1, U22383.1, AE000658.1, AL163244.2, AB016214.1, U51234.1,
AL136501.2, AL035690.10, AL008732.1, AL021367.1, U62778.1, U10037.1, U01157.1, AP001699.1, AP001604.1,
M24635.1, X75598.1, D16413.1, L23503.1, UG1104.1, AA463600.1, Z46206.1, R93559.1, R18599.1, C03715.1,
AA493510.1, AA610816.1, AI954758.1, Z24812.1, AV373707.1, AV274641.1, AV261266.1, AI482404.1, T63643.1,
AW851555.1, AW782871.1, AW764717.1, AW199070.1, AW187754.1, M867176.1, AI779970.1, AI778733.1,
AI778732.1, AI777779.1, AV072748.1, AU052904.1, AI191468.1, AI061454.1, C25 733.1, AA517468.1, AA491434.1,
C07818.1, H30070.1, AC025449.3, AC068719.1, AC025246.5, AC017005.4, AC068601.3, AC024183.3, AC022848.3,
AC069130.1, AC009235.2, AC007322.3, AC024236.3, AC008061.1, AC007965.2, AC007315.2, AC068541.3,
AC053495.3, AC022486.3, AC010146.5, AL354667.1, AC058810.3, AC026605.3, AC069232.1, AC021756.11,
AC024043.4, AC021311.4, AC018967.3, AC022602.1, AC020065.1, AL356234.2, AL35475 5.2,
SEQ ID NO. 300
NGO-St-134
YS1695/T3 5'

NM_003611.1, Y16355.1, Y15164.1, AC003037.1, AC006991.2, AC016707.2, AC008175.2, AC007379.2, AC010682.2,
AC009947.2, AF121351.1, AE003417.1, AC005039.1, AF077408.1, AL161498.2, AF016655.1, AL050231.2,
NC_001.1U.1, AC010498.4, AF140536.1, AE003690.1, AE003542.1, NM_002062.1, AC009514.2, AC006026.2,
AC006065.3, U44051.1, U85195.1, U01156.1, AC005179.1, U22383.1, AE000658.1, AL163244.2, AB016214.1,
U51234.1, AL136501.2, AL035690.10, AL008732.1, AL021367.1, U62778.1, U10037.1, U01157.1, AP001699.1,
AP001604.1, M24635.1, L23503.1, U01104.1, AA463600.1, Z46206.1, R93559.1, R18599.1, C03715.1, AA493510.1,
AA610816.1, AI954758.1, AV373707.1, AV274641.1, AV261266.1, AI482404.1, T63643.1, AW782871.1, AW764717.1,
AW199070.1, AW187754.1, AI779970.1, AI778733.1, AI778732.1, AI777779.1, AV072748.1, AI191468.1, AI061454.1,
AA517468.1, AA491434.1, C07818.1, AC025449.3, AC068719.1, AC007322.3, AC024236.3, AC008061.1, AC007965.2,
AC007315.2, AC068541.3, AC053495.3, AC022486.3, AC069130.1, AC009235.2, AC024183.3, AC022848.3,
AC068601.3, AC010146.5, AL354667.1, AC058810.3, AC026605.3, AC069232.1, AC021756.11, AC018967.3,
AC020065.1, AL356234.2, AL354755.2, AC044879.3, AC009545.4, AC018905.4, AC068284.2, AC023596.7,
AC023105.4, AC068275.2, AC025586.1, AC022448.3, AC010423.5, AC011378.3, AC011404.4, AC019198.2,
AC044779.3, AC026076.2, AC009692.3, AC025038.3, AC026529.2, AC034290.1, AC015988.3, AC022937.3,
AC019039.2, AC021936.1, AC021312.1, AC020414.1, AC012565.2, AC014964.1, AC007645.3, AL139147.3,
AL133402.10, AL162739.4, AL160167.5, AL353621.2, AP001998.1, AP000916.2, AP001524.1, AP001491.1,
AP000723.1, AP000629.1,
SEQ ID NO. 301
NGO-St-134
YS1695/T7 3'

NM_003611.1, Y16355.1, Y15164.1, AC003037.1, AC007379.2, AC016752.2, AC008175.2, NM_007845.1, S77750.1,
U12565.1, AC024823.1, AE003682.1, AE002142.1, AF165124.1, AC005220.1, AL021328.1, AL009175.1, NM_010077.1,
AF143381.1, AC003042.1, AL117375.12, Z99772.1, X55674.1, D67043.1, AC005310.2, AC009327.6, AC008125.9,
U21319.1, AC005371.1, AC002090.1, A.1235271.1, AB026658.1, AI916605.1, AI867405.1, AI971431.1, AI867404.1,
AI376969.1, AI769120.1, AI634116.1, AI245948.1, AW167287.1, AA399610.1, AA173950.1, AA778870.1, AW118555.1,
AI627406.1, AI769378.1, AI804265.1, AI309530.1, AW296642.1, D52284.1, AI277389.1, AI304731.1, N57735.1,
AI280957.1, AA504821.1, AI049632.1, C14646.1, AA780326.1, C14712.1, AA994778.1, R41679.1, AI916018.1,
T16276.1, N57749.1, AA173595.1, AA824530.1, AA621466.1, AW009492.1, D53159.1, AI917863.1, H05597.1,
AW885416.1, AI908207.1, D60992.1, AI908204.1, AI561264.1, AI277708.1, W35241.1, AI620904.1, Z41831.1,
AI277709.1, D53722.1, AI277707.1, AA428032.1, AA514458.1, D60582.1, D80593.1, AW118344.1, AI824750.1,
AI719888.1, AI908201.1, D60909.1, R93560.1, D80428.1, AW887698.1, AW450863.1, AI333241.1, AA707111.1,
AA693788.1, AW072670.1, AI022424.1, C14580.1, AI471729.1, AA398975.1, AI719895.1, AW271458.1, W23787.1,
AW416841.1, AW554784.1, AW542764.1, AI480837.1, AW785419.1, AW785418.1, AI5 54988.1, AA634447.1,
AW485325.1, AW375050.1, AW297567.1, AA871518.1, AA869516.1, AV197207.1, R14712.1, AW563271.1,
AW270811.1, AI507728.1, AA247528.1, AC025449.3, AC068541.3, AC022486.3, AC007322.3, AC007965.2,
AC007315.2, AC018789.2, AC008061.1, AC022783.2, AC020972.1, AC063924.3, AC008611.4, AC026910.2,
AC021619.3, AC006879.2, AC006796.1, AC068165.1, AC021471.2, AC010873.3, AC015517.2, AL137069.2,
AL158045.2, AC013318.4, AC063960.2, AC034138.2, AC012686.3, AC018872.2, AL13712.5,2, AL136218.7,
AL353607.2,

TABLE 1-continued

Sequence homologies (GenBank Accession Numbers)

SEQ ID NO. 302
NGO-St-134
YS318/T3 5'

NM_003611.1, Y16355.1, Y15164.1, AC003037.1, AC010682.2, AC007379.2, AC006991.2, AC008175.2, AC009947.2, AE003417.1, AC005039.1, AF117269.1, U09819.1, AF016655.1, AL050231.2, Z99121.1, X71360.1, AP002039.1, NC_001144.1, AC009411.2, AF140536.1, AE003690.1, NM_002062.1, AC009514.2, AC006026.2, AC006065.3, AC005839.1, U44051.1, U85195.1, U01156.1, U22383.1, AE000658.1, AL163244.2, AB016214.1, U51234.1, AL035690.10, AL008732.1, AL021367.1, U62778.1, U10037.1, U01157.1, AP001699.1, AP001604.1, M24635.1, X75598.1, D16413.1, L23503.1, U01104.1, R93559.1, AA463600.1, C03715.1, Z46206.1, R18599.1, AA493510.1, Z24812.1, AV373707.1, AV274641.1, AV261266.1, AI482404.1, AW851555.1, AW782871.1, AW764717.1, AW199070.1, AW187754.1, AI867176.1, AI779970.1, AI778733.1, AI778732.1, AI777779.1, AU052904.1, C25733.1, AA517468.1, AA491434.1, C07818.1, H30070.1, AC025449.3, AC068719.1, AC025246.5, AC017005.4, AC068601.3, AC024183.3, AC022848.3, AC069130.1, AC009235.2, AC068541.3, AC022486.3, AC007322.3, AC024236.3, AC008061.1, AC007315.2, AC010146.5, AL354667.1, AC058810.3, AC026605.3, AC069232.1, AC024043.4, AC021311.4, AC022602.1, AC020065.1, AL356234.2, AC044879.3, AC009545.4, AC018905.4, AC026076.2, AC026925.2, AC022937.3, AC016803.2, AC019039.2, AC012507.3, AC020414.1, AC007645.3, AC005059.1, AL139147.3, AL133402.10, AL162739.4, AP001998.1, AP000723.1,

SEQ ID NO. 303
NGO-St-134
YS318/T7 3'

NM_003611.1, Y16355.1, Y15164.1, AC003037.1, AC007379.2, AC016752.2, AC008175.2, AC024823.1, AE003682.1, AE002142.1, AC005046.3, AF165124.1, AC005220.1, AE002140.1, AF143381.1, AC005922.1, AC003042.1, AL121674.12, AL033378.12, AL117375.12, Z99772.1, AL031285.1, D67043.1, AC005310.2, AC006029.2, AC009327.6, AC005827.3, AC005371.1, AJ235271.1, AL137189.1, AL008729.1, AB026658.1, AI867405.1, AI916605.1, AI971431.1, AI376969.1 AI867404.1, AI769120.1, AI634116.1, AI245948.1, AA173950.1, AA399610.1, AA778870.1, AW167287.1, AW118555.1, AI769378.1, AI627406.1, AI804265.1, AI309530.1, AW296642.1, AI277389.1, AI304731.1, N57735.1, D52284.1, AI280957.1, AA504821.1, AI049632.1, AA780326.1, C14646.1, AA994778.1, R41679.1, M916018.1, C14712.1, T16276.1, N57749.1, AW009492.1, AA824530.1, AA621466.1, AI917863.1, D53159.1, AA173595.1, H05597.1, AW885416.1, D60992.1, W35241.1, AI908207.1, AI620904.1, Z41831.1, AI908204.1, AA428032.1, AA514458.1, D53722.1, D60582.1, AI561264.1, D80593.1, AI277708.1, AI277709.1, AI824750.1, AI719888.1, AI277707.1, R93560.1, D60909.1, D80428.1, AW887698.1, AW118344.1, AI908201.1, C14580.1, AI471729.1, AI719895.1, AW450863.1, AW072670.1, W23787.1, AW271458.1, AI333241.1, AA398975.1, AI022424.1, AA707111.1, AA693788.1, AW416841.1, AW554784.1, AW542764.1, AI480837.1, AW785419.1, AW785418.1, AI554988.1, AW485325.1, AV197217.1, R14712.1, AW563271.1, AW270811.1, AW119241.1, AI507728.1, AA247528.1, AC025449.3, AC068541.3, AC022486.3, AC007322.3, AC007965.2, AC007315.2, AC018789.2, AC008061.1, AC024524.3, AC063924.3, AC008611.4, AC021619.3, AC006796.1, AL136367.2, AL158205.4, AC021471.2, AC023409.1, AC010873.3, AC012501.1, AL159970.8, AP001318.1, AC012543.3, AC053523.2, AC008890.3, AC008732.4, AC034138.2, AL137125.2, AL136218.7,

SEQ ID NO. 304
NGO-St-135 5' combined

NM_014781.1, D86958.1, Z35085.1, X82318.1, NC_001865.1, AB001684.1, Z72514.1, AC002302.1, AC007486.1, AL049755.2, X79489.1, Z35853.1, AC010151.3, AC009234.3, AF083915.1, AL139074.2, AL132862.1, AC013737.4, U36927.3, AE003692.1, AC006473.2, AF056336.1, AL136363.4, AW502603.1, AI632607.1, AI889925.1, R59196.1, Z40222.1, H28996.1, Z30060.1, AW663145.1, N36767.1, T32056.1, T39659.1, T40715.1, AA063364.1, AW271526.1, AA795138.1, AW771911.1, AA998419.1, AI466480.1, AA880393.1, AI482282.1, AI841402.1, W52752.1, AI786567.1, AV221321.1, BB006621.1, AV254733.1, AW865505.1, AV330249.1, AL044138.1, AI655038.1, AV316950.1, AV348716.1, AV274459.1, AV317688.1, AV280612.1, AV352758.1, AV349442.1, AV245740.1, AV318689.1, AV330001.1, AV328749.1, AI138828.1, AA047474.1, R17528.1, R13828.1, T38143.1, AW861328.1, AW426185.1, AI980387.1, AI959585.1, AI621380.1, Z29358.1, AW851165.1, AV440128.1, AW203956.1, AV347279.1, AI830629.1, AI488952.1, AI361260.1, AI281023.1) AI276138.1, AA828299.1, AA682840.1, AA449644.1, AA425466.1, AC018960.3, AC037464.2, AC018621.3, AC023756.2, AC024.448.2, AC016201.5, AL161663.1, AC023777.3, AC006279.6, AL022285.6,

SEQ ID NO. 305
NGO-St-135
YS374/T3 5'

NM_014781.1, D86958.1, Z35085.1, X82318.1, AL049755.2, D87675.1, AP001442.1, AP000141.1, AP000089.1, AC010151.3, AC2009234.3, AC005771.1, AC006761.1, AE003692.1, AF172282.1, AC006478.2, AE001577.1, AC006473.2, AC006222.1, AF100669.1, AF016420.1, AL050322.10, AL022166.1, AB009049.1, AI889925.1, AW663145.1, H28996.1, Z40222.1, N36767.1, T32056.1, R59196.1, T39659.1, T40715.1, AA063364.1, AW271526.1, AA795138.1, AW771911.1, AA998419.1, AI482282.1, AI841402.1, AV221321.1, BB006621.1, AV254733.1, Z30060.1, AW865505.1, AV330249.1, AI655038.1, AV316950.1, AV348716.1, AI786567.1, AV274459.1, AV317688.1, AV280612.1, AV352758.1, AV349442.1, AV245740.1, AV318689.1, AV330001.1, AV328749.1, AI138828.1, AA047474.1, R17528.1, R13828.1, R20722.1, AW861328.1, AI980387.1, Z29358.1, AW851165.1, AW816256.1, AW572236.1, AV391062.1, AW328120.1, AV347279.1, AV220950.1, AW140056.1, AI830629.1, AI281023.1, AI276138.1, M042194.1, AA682840.1, AA411650.1, AA194887.1, AA189098.1, H85292.1, R55580.1, AC018960.3, AL138741.3, AC022235.2, AC022198.2, AC023756.2, AL161663.1, AC023777.3, AC022224.20, AC019223.2, AL109767.2, AC022148.4, AC009138.5, AC016516.3, AC026891.1, AC016272.3, AC013530.3, AL354668.1, AL162211.3, AL049185.4,

TABLE 1-continued

Sequence homologies (GenBank Accession Numbers)

SEQ ID NO. 306
NGO-St-135
YS382/T3 5'

NM_014781.1, D86958.1, NC_001865.1, AB001684.1, AC006443.1, Z72514.1, AC004401.2, AC002302.1, AC007486.1, X79489.1, U41015.1, Z35853.1, Z35852.1, AL050403.13, AB019235.1, AC013737.4, U36927.3, AF121898.1, AE001381.1, AC004171.1, AF056336.1, AL136363.4, AL109983.1, AW502603.1, AI632607.1, Z30060.1, R59196.1, AI466480.1, AA880393.1, W52752.1, Z40222.1, H28996.1, AI786567.1, AL044138.1, p9659.1, T38143.1, AW426185.1, AI959585.1, AI621380.1, AV440128.1, AW614639.1, AJ396349.1, AW467130.1, AW251790.1, AW251721.1, AW203956.1, AV381555.1, AW139206.1, AV384482.1, AW047876.1, AI996020.1, M849553.1, AI776841.1, AI774351.1, AU073206.1, AI712752.1, AI584023.1, M488952.1, AI474049.1, AI373038.1, AI361260.1, AI175635.1, AI081464.1, C92808.1, AA828299.1, AA449644.1, AA425466.1, AA397984.1, AA192413.1, W80808.1, N34826.1, R27823.1, AC018960.3, AC037464.2, AC024448.2, AC012389.10, AL356295.3, AL160257.3, AC037454.2, AC064864.1, AC013328.5, AC004153.5, AC010985.3, AC006903.1, AL354763.1,

SEQ ID NO. 307
NGO-St-135
YS382/T7 3'

NM_014781.1, Z35085.1, D86958.1, X82318.1, AE003435.1, AC007371.16, AC007489.3, AC024763.1, AE003558.1, U80446.1, AW771911.1, AW271526.1, AI138828.1, M655038.1, AA047474.1, R13828.1, AI122747.1, AA047435.1, R23393.1, R55580.1, H10270.1, AA374617.1, W60007.1, R17528.1, C75251.1, R22753.1, F13181.1, F11154.1, AI889925.1, N36767.1, R20722.1, AA952920.1, I77023.1, AA206152.1, AI153537.1, AI841402.1, AA795138.1, AA063364.1, AA692714.1, AV316950.1, AI785170.1, AA200762.1, AV330249.1, AA998419.1, AV274459.1, AA976511.1, AA823667.1, AV221321.1, AW130616.1, BB006621.1, R16741.1, AV254733.1, AV280612.1, AV317688.1, AV349335.1, AV348716.1, AA808066.1, AW551190.1, AI627011.1, AV318248.1, AI447566.1, M302306.1, AA974918.1, T24196.1, AC018960.3, AC051613.3, AC014392.1, AC013253.6, AC013535.4, AC016130.13, AC010113.4, AC017388.1, AC010557.2, AC006714.2, AC006746.1, AL355924.1,

SEQ ID NO. 308
NGO-St-136
YS042/T3 5'

NM_002707.1, AX002424.1, Y13936.1, U81159.1, NM_008014.1, U42383.1, AX002422.1, AL049551.1, L31397.1, AF249327.1, NM_011577.1, AF105069.1, L42456.1, U41021.1, AJ009862.1, M57902.1, AB009874.1, AC006592.5, NM_011668.1, NM_0104731 NM_008272.1, AP114039.1, AC007130.2, AF158597.1, AF132218.1, AF082835.1, AL022070.1, Ut 8428.1, U96636.1, U82122.1, AL138558.1, U61980.1, X55318.1, X07647.1, M35603.1, AC010285.4, AC003692.1, AC010556.4, A0005908.1, AC005943.1, Z66566.1, AL136039.2, AL109967.2, Z85987.13, AP001595.1, AI650583.1, AI992326.1, AW384902.1, AW239336.1, AI879664.1, AW249422.1, AA070392.1, AW577345.1, AW659941.1, AW659925.1, AL042520.1, AW367060.1, AW361618.1, AI894150.1, AA211434.1, AW672699.1, AW161662.1, AI928871.1, AA320736.1, AW850023.1, AI878909.1, AW849906.1, AI879284.1, T06191.1, AW490146.1, AA383664.1, H32905.1, AW163699.1, D76591.1, AA115688.1, AW160907.1, AW082745.1, AI417405.1, AA834611.1, AA085449.1, AI878881.1, AI929038.1, AA074643.1, N88715.1, AW578051.1, AW382863.1, W39347.1, W34891.1, AW321752.1, AL045879.1, AA171301.1, W65536.1, AA383628.1, AI879435.1, AW062337.1, AW630504.1, AW872109.1, AA510019.1, AW871903.1, AW782552.1, AW762009.1, AI940409.1, AI323364.1, AA646479.1, AA190384.1, AC009427.2, AC025903.1, AC007497.2, AC027499.3, AC025642.2, AC022174.2, AL356108.2, AL158171.3, AP001128.1, AC026954.3, AC008006.3, AC027299.6, AL158816.4, AL117187.2, AC064846.3, AC026413.2, AC016575.6, AC026833.2, AC025898.2, AC016837.3, AC015677.4, AC021697.4, AC023379.2, AC023804.7, AC008841.1, AC024264.1, AC012531.1, AF165178.1, AL035477.5, AP001099.1,

SEQ ID NO: 309
NGO-St-136
YS042/T7

NM_002707.1, Y13936.1, A.X002424.1, NM_008014.1, U42383.1, U81159.1, U83913.1, Z81114.1, Z78415.1, AL163233.2, U28789.1, AP001688.1, AP000961.2, AF213465.1, AC004519.1, AC002428.1, AC004839.1, AC007237.3, AF147259.1, U23527.1, AC004503.1, AL161507.2, AL163254.2, AL135744.2, AL049539.21, Z71782.1, AP001709.1, X87579.1, AP000204.1, AP000244.1, AP000126.1, M20814.1, AI623188.1, AI949680.1, AI769584.1, AW003495.1, AI016791.1, AW514319.1, AI674866.1, AA708807.1, AI954672.1, AI690420.1, AW771608.1, AW129519.1, AI563921.1, AA418416.1, AL044111.1, AI432554.1, AI634705.1, AI570350.1, AW087864.1, AA938139.1, AI917417.1, AI802218.1, M432562.1, AW250025.1, AW675447.1, AI697620.1, AI686700.1, AI359192.1, AI634891.1, AI587529.1, AI290844.1, M619769.1, AW163096.1, AI150541.1, N53494.1, AI933325.1, AA190579.1, AI687672.1, AI204201.1, AI435812.1, AI335028.1, AW079871.1, AI587523.1, AI885074.1, AA831968.1, AA292839.1, AI378193.1, AA418531.1, AA115707.1, AI983072.1, AI991100.1, AL046114.1, AA132539.1, AI057142.1, AI962687.1 AI825350.1, AI637949.1, AI754481.1, AA460426.1, N36716.1, AW516535.1, AI445408.1, AA126965.1, N26077.1, AA613447.1, AA133683.1, AA994318.1, T30419.1, AI207138.1, AA470639.1, AW612812.1, AA151641.1, AA079391.1, AI683064.1, AI655486.1, W38314.1, AW806697.1, AW605433.1, AI018391.1, AA580007.1, AA398675.1, AW136714.1, AA465129.1, AA070393.1, AA465723.1, W38641.1, AI634337.1, C02081.1, AI675741.1, AI372924.1, AA621622.1, AI909888.1, AA587456.1, P22497.1, Z39444.1, AW361020.1, AI909859.1, AI690302.1, R53936.1, AI963691.1, AL160290.3, AC048362.2, AC027484.3, AC026473.3, AC009169.4, AC009664.4, AC022478.3, AC010735.3, AC015622.3, AL137066.5, AL009206.1, AC037452.2, AC068637.3, AC069218.1, AC024094.8, AC006337.3, AC019043.3, AC040940.1, AC020685.3, AC011849.3, AC009549.3, AC021114.3, AC021002.3, AC016989.4, AC018717.5, AC020892.3, AC009665.4, AC016746.3, AC012529.1, AC004624.6, AC007913.1, AC007438.6, AC006086.7, AC006087.12, AC004670.1, AC005141.1, AL162264.4, AI355531.1, AL354876.1, AP001562.1,,

SEQ ID NO: 310
NGO-St-137
YS1671/T3

NM_015873.1, D88154.1, AP000497.1, J03781.1, AC007630.3, AL049867.2, AC008989.6, NM_009509.1, AF009332.1, X85787.1, Z94160.1, AL163292.2, AP001747.1, AP001625.1, M98454.1, D26083.1, AL040451.1, AW226642.1,

TABLE 1-continued

Sequence homologies (GenBank Accession Numbers)

AW344693.1, AA222407.1, AA272458.1, AA109911.1, AW049791.1, AI842717.1, AW336334.1, H31419.1, AI94464&1,
AA871446.1, AI003346.1, AC015624.2, AC055818.1, AC015627.1, AC009292.7, AC021133.3, AL109918.24,
AC023547.3, AC025871.3, AC058789.9, AC064818.3, AC027567.2, AC021876.3, AC011132.4, AF235106.1,
AC009837.2, AL136090.10, AL136966.6, AP001274.,
SEQ ID NO: 311
NGO-St-137
YS1671/T7

NM_015873.1, D88154.1, AP000497.1, AE003608.1, AC005750.1, AC005164.1, AC004453.1, AE002079.1, AC007870.3,
L48729.2, AC006211.1, U50713.1, US2431.1, AP000003.1, AB004870.1, AI207789.1, AI828390.1, AI887514.1,
AI991204.1, AW087315.1, AI004782.1, AI394648.1, AW627720.1, AI660044.1, AA088690.1, AI699257.1, AA088827.1,
AI440449.1, T57294.1, AW197506.1, AA641469.1, AL040452.1, AA992660.1, W85454.1, AV270064.1, AV143508.1,
AW701384.1, AW908944.1, AW701603.1, AI182951.1, AW911867.1, AW665415.1, AW629286.1, AW593227.1,
AW575674.1, AW573162.1, AW573006.1, AW510703.1, AW340493.1, AW274644.1, AW183086.1,
AW104924.1, AW082305.1, AI927494.1, AI868632.1, AI829672.1, AI827875.1, Ad510093.1, AI809958.1, AI808895.1,
AI805139.1, AI740990.1, AI685360.1, AI290316.1, AI276754.1, AI273268.1, M247350.1, M222006.1, AA919014.1,
AA913475.1, AA411451.1, AC015624.2, AC015627.1, AC022034.3, AC020275.1, AC018448.8, AL139236.3,
AC069272.3, AC016257.6, AC009466.7, AC024947.2, AC026456.2, AC032008.2, AC027694.2, AC023136.3,
AC024720.3, AC023437.2, AC016168.3, AC020778.4, AC010833.3, AC018492.3, AC024158.1, AC021911.1,
AC004958.1, AL139342.4, AL133291.3, AP001031.2, AP001802.1, AP001500.1, AP000880.1,
SEQ ID NO: 312
NGO-St-138
YS171/T3

NM_002310.2, X616151 NM_013584.1, S73495.1, D26177.1, S73496.1, D17444.1, D86345.1, U97364.1, M95099.1,
AC010140.3, AC006446.3, AE003824.1, AE003687.1, AE003458.1, AF077407.1, AC004829.2, AC005965.1,
AC003688.1, U15422.1, AL132902.2, AL132950.1, AB005248.1, AE003742.1, AE003521.1, U89335.1, AC006193.3,
AF086440.1, Z81565.1, Z47547.1, AL353871.1, AL138664.1, AL136538.1, AL049550.5, AL035423.4, U19467.1,
U28735.1, AJ224683.1, Z11527.1, AB000565.1, T18495.1, AA207338.1, M226136.1, W20740.1, AI894070.1,
AA023181.1, AII95387.1, AA245317.1, AW626804.1, AW529846.1, AW529284.1, AW527135.1, A.T397726.1,
AW434719.1, AW355500.1, AW299470.1, AV334964.1, AW294188.1, AW038883.1, AI715801.1, AI575955.1,
AA997228.1, AI415987.1, AI011427.1, AA534664.1, AA440412.1, AA193084.1, W81340.1, W81339.1, W79447.1,
N42705.1, D69835.1, H59829.1, AC010457.5, AC016324.4, AC022850.3, AC023948.2, AC068662.1, AC025882.2,
AC015938.3, AC024169.1, AL354889.4, AL355587.3, AL161660.6, AL162852.3, AC026954.3, AC010176.7,
AC010395.5, AC012610.4, AC008782.4, AC027785.2, AC021621.3, AC013642.3, AC019195.4, AC022040.2,
AC025285.1, AQL21883.2, AC020182.1, AC020286.1, AC013646.3, AC008232.3, AC018232.1, AC007770.4,
AC007822.3, AL158053.2, AC020639.4, AC068892.1, AC010376.3, AC012316.4, AC068216.1, AC009627.3,
AC026038.2, AC009833.3, AC019141.3, AC013466.2, AC011172.4, AC010003.5, AC009368.5, AC021801.1,
AC019524.1, AC020018.1, AC008200.3, AC007910.1, AC006714.2, AL139190.4, AL139098.4, AL137780.2,
AL160263.3, AL353606.2,
SEQ ID NO: 313
NGO-St-138
YS171/T7

NM_002310.2, U66563.1, AC018748.3, AF220294.1, AC020728.4, AC009526.4, AC004861.1, AC002457.1, U12386.1,
AF064866.1, AE000722.1, AF043945.1, U23517.1, AC000103.1, AL355916.1, AL163283.2, U19289.1, U02537.1,
AB017064.1, AC006991.2, AC007661.2, AE003735.1, AE003696.1, AE003562.1, AE003559.1, AC009947.2,
AC004746.1, AC004081.1, AF077407.1, AF051985.1, NM_000810.2, AC004453.1, AC004993.1, AC006044.2, U42580.2,
AF039907.1, AC007159.4, AC006409.2, AC005965.1, U89714.1, AC005176.1, Z83105.1, AL022289.1, U73646.1,
U73642.1, AL163261.2, AL121787.22, U65744.1, AL161666.2, X70645.1, X96995.1, L08485.1, AP001716.1,
AP000188.1, AP000044.1, AP000298.1, AP0001L2.1, AI915539.1, AI439137.1, N67017.1, AI140597.1, R38064.1,
R38159.1, AW766681.1, AW760222.1, AW645026.1, AW644379.1, AW769415.1, AA825445.1,
AA601263.1, AW633848.1, AW384967.1, AV361643.1, AI856958.1, AI807646.1, AI787356.1, AA833639.1,
AA631386.1, AA322964.1, AA176759.1, D68013.1, AC010457.5, AC040167.2, AC008074.2, AC021418.3, AC026685.1,
AC018821.3, AC0I8829.3, AC007906.2, AC068278.2, AC026811.2, AC068398.1, AC018958.2, AC024235.2,
AC040994.1, AC024454.2, AC019295.3, AC022600.1, AC004133.1, AL138931.2, AL157936.3, AL163540.3,
AP001536.1, AP000609.Z
SEQ ID NO: 314
NGO-St-139
YS313/T3

NM_004404.1, AF038404.1, D28540.1, D63878.1, NM_010891.1, D49382.2, AC005104.1, L23246.1, X67202.1,
NM_004574.1, AF073312.1, U88870.1, U88829.1, AP035811.1, NM_011129.1, X61452.1, AC0037.1, AF1297561
AJ012008.1, AP000504.1, AE003568.1, AF181897.1, AF113831.1, AE000578.1, AE001491.1, AF063866.1, AF017777.1,
AL163002.1, AL162751.1, U97193.1, M65026.1, Z98547.1, X57924.1, AP001313.1, D64003.1, AB005240.1, D10774.1,
NC_001139.1, AE003501.1, AE003691.1, AC005067.2, AC007681.3, AC006949.8, AC006112.2, AC006602.1,
AC006502.2, AF106564.1, U00067.1, AC004293.1, AF014008.1, Z72946.1, AL117193.1, AL137230.2, AL035685.21,
AJ243530.1, AL021182.1, AL049569.13, AL022397.1, X85807.1, Z72944.1, X57185.1, AJ224373.1, X88845.1,
U19801.1, L17338.1, AL043232.2, AA503494.1, AI299913.1, AI557336.1, AA134778.1, AA908712.1, AA516460.1,
AW804638.1, AA207185.1, AA346077.1, AA346067.1, AW517043.1, AW580618.1, T79554.1, AA703550.1,
AW580614.1, AW175610.1, AW175626.1, AW901420.1, AA309749.1, AW196938.1, AW175616.1, R58037.1, H34478.1,
H34850.1, AA063813.1, AA405068.1, AI362531.1, AI588750.1, AW918329.1, AI740549.1, AA278469.1, AA278468.1,
L44311.1, AW362022.1, AA091277.1, AI191427.1, W07036.1, AW242840.1, AI801603.1, AW380702.1, AW364487.1,
AW379484.1, N85237.1, W39483.1, AW607052.1, AI557335.1, AU000539.1, AA067306.1, AJ394459.1, AW128456.1,
R89377.1, AW911380.1, AI287193.1, AW298883.1, AJ392338.1, AA325361.1, AW903179.1, AI991202.1, AI765951.1,
AI632238.1, AI459499.1, AA780116.1, AA325651.1, AA324802.1, AA055270.1, AA024634.1, W69297.1, AW209482.1,
M894076.1, AI877025.1, AI323320.1, AI181122.1, AA023716.1, AII140073.1, AW691387.1, AW637056.1, AI412920.1,

TABLE 1-continued

Sequence homologies (GenBank Accession Numbers)

AI411171.1, AI116225.1, AA097604.1, N57875.1, AW462213.1, M881739.1, M5844111c579171AC0193182
AC022958.1, AC012304.2, AC011757.10, AC009395.5, AC018015.1, AL132713.5, AC068059.2, AC008547.4,
AC009563.3, AC007131.3, AC055122.1, AC018574.3, AC024722.2, AC025834.1, AC013980.1, AF165425.1,
AL353738.7, AL161432.3, AC022278.9, AC023507.5, AC019070.2, AC069047.1, AC020594.2, AC062030.2,
AC067961.3, AC025188.3, AC024579.3, AC020927.4, AC010477.6, AC010475.3, AC008933.4, AC008515.5,
AC008485.3, AC010289.3, AC027023.2, AC027676.2, AC008068.3, AC016881.4, AC027042.2, AC053481.1,
AC037477.1, AC021842.3, AC018953.5, AC015810.3, AC018684.2, AC024518.2, AC021000.3, AC016841.2,
AC007710.10, AC023958.2, AC007223.1, AC016760.3, AC012354.3, AC017587.1, AC014457.1, AC008358.3,
AL355335.3, AL109931.15, AL356372.1, AL139812.5, AL034372.30, AL133271.15, AL121952.6, AL162332.1,
AL133168.1, Z98855.1, AP001591.1,
SEQ ID NO: 315
NGO-St-139
YS313/T7

NM_004404.1, AC005104.1, AF038404.1, D63878.1, D28540.1, NM_010891.1, D49382.2, AL031779.5, Z98754.1,
AL163229.2, AP001684.1, AP000657.1, AP000561.1, NM_015759.1, AF017369.1, AF038172.1, AE003820.1,
AC004615.1, AC008165.3, AC005078.1, AC006572.2, AC005184.1, AC005242.1, AL049557.19, AC000386.1,
AL157991.1, AL121963.10, AL132846.1, Z68276.1, AP001306.1, M63453.1, AI753689.1, AI114531.1, A.1754501.1,
AI088934.1, AW152364.1, AI609395.1, AA639591.1, AI160331.1, AI951387.1, AI955165.1, AI573059.1, AW473653.1,
AI956125.1, AI126301.1, N21100.1, AI089658.1, AI632807.1, AW273787.1, N35895.1, AW020474.1, AI094932.1,
AW026345.1, N67318.1, AW339045.1, AW886537.1, AA234940.1, AA137035.1, AW514047.1, AI346269.1,
AA218642.1, N67464.1, AA516108.1, AI829564.1, AI683327.1, AI355722.1, AA516499.1, AW022200.1, AA234941.1,
AA206067.1, AI564619.1, AW769271.1, AI357439.1, AW517058.1, AI635685.1, AI087118.1, AI273328.1, AI143819.1,
AI051872.1, AW474968.1, AW167451.1, AI754942.1, AI708338.1, AA775507.1, AA565842.1, AI130699.1, AA809247.1,
AA430153.1, T15553.1, AW023986.1, AW469297.1, AI039303.1, AI521676.1, AA971524.1, AA487437.1 AW302623.1,
AI880684.1, AI143019.1, AA812690.1, AI081421.1, AA043265.1, AW771795.1, AA599961.1, AA181698.1, AA071074.1,
AI754299.1, AI355732.1, AI027964.1, AI338308.1, AA808182.1, AA209392.1, AW192277.1, AI858793.1, AI304415.1,
AI225151.1, AI139335.1, AW337224.1, AI434203.1, AI565741.1, AI217047.1, AI190711.1, AW129449.1, N25544.1,
N53355.1, AW771405.1, AI636810.1, AI096434.1, AA928349.1, AA599844.1, AI024553.1, AI830555.1, AC067872.1,
AC012304.2, AC019318.2, AC013382.3, AC022958.1, AL137008.2, AC027057.3, AC024706.3, AC011210.3,
AL121819.2, AC010600.3, AC008525.4, AC027182.1, AC009146.2, AL133383.6, AC058801.2, AC027523.2,
AC022912.3, AC025164.8, AC021662.8, AC018548.7, AC021873.7, AC012514.8, AC069223.1, AC068763.2,
AC069025.1, AC069013.1, AC068070.2, AC068708.2, AC007511.2, AC011209.3, AC067953.2, AC027344.2,
AC026410.2, AC010419.3, AC046162.2, AC027812.2, AC067899.1, AC026935.2, AC020684.4, AC020778.4,
AC024053.2, AC022986.3, AC021111.3, AC025706.3, AC013303.3, AC011774.4, AC024503.2, AC022923.3,
AC016515.3, AC013637.3, AC023560.2, AC022568.3, AC025489.1, AC008853.1, AC005472.14, AC007472.5,
AC022016.2, AC014851.1, AF166490.1, AC007702.1, U82207.1, AL157761.2, AL137402.2, AL356218.1, AL353136.3,
AL132868.12, AL355373.1, AL354809.1, AL161933.3, AL353731.1, AL159980.3, AL136360.7, AL135818.2,
AL035066.20, AL021573.1, AP001848.1, AP001487.1, AP001486.1, AP0010I8.1, AP000875.1, AP000789.1,
SEQ ID NO: 316
NGO-St-140
YS2312/T3

NM_004724.1, U54996.1, AJ250458.1, AE003557.1, AC003949.1, AJ012166.1, U39676.1, AL031785.1, AC006332.3,
AF244289.1, AF244276.1, AF244264.1, AF244262.1, AF244261.1, AE003628.1, AC003060.1, AC004830.1, AC004887.2,
AE001709.1, A0005454.1, AFO81108.1, AC005293.1, Z81567.1, Z69386.1, AL133334.16, S70930.1, AL138655.1,
M80829.1, AL137961.1, AW107591.1, AA693260.1, AV046851.18, AV147645.1, AA692808.1,
AI396591.1, AJ395373.1, AW375854.1, AV362443.1, AW003698.1, AI887627.1, C77594.1, AA541074.1, Z92701.1,
AA148712.1, AC036188.2, AC068190.1, A0036226.1, AC020808.2, AP001882.1, AP000913.2, AP000744.1,
AC021176.3, AC006591.12, AC018042.1, AC008303.1, AC026900.3, AC027690.4, AC027341.2, AC010276.5,
AC024383.3, AC023774.3, AC025551.3, AC019145.5, AC013693.3, AC023632.1, AC022652.1, AC010885.3,
AC018617.2, AL138884.3, AL138796.3, AL136086.3, AL096819.1, AC036166.3, AC027821.3, AC070078.2,
AC009783.7, AC012040.9, AC068764.2, AC012526.20, AC019041.3, AC053479.2, AC036181.2, AC060829.2,
AC021082.2, AC010631.4, AC026474.3, AC026464.3, AC018646.1, AC064794.1, AC019055.3, AC024067.3,
AC053522.1, AC051661.1, AC026561.2, AC012130.2, AC019058.3, AC023881.2, AC021469.3, AC011562.4,
AC015523.3, AC011972.3, AC011277.4, AC023013.2, AC024630.1, AC020607.2, AC021317.2, AC015973.1,
AC013268.1, AC009849.6, AC012796.1, AL355853.3, AL355005.2, AL356117.1, AL136118.3, AL135915.2, Z98876.1,
SEQ ID NO: 317
NGO-St-140
YS2312/T7

NM_004724.1, U54996.1, AF003951.1, AC008085.1, AC004520.1, AF011889.1, AE001131.1, Z99162.1, AL031275.1,
AP002068.1, AE003825.1, AE003435.1, AC007636.19, AC018833.3, NM_006389.1, AC005483.1, AC007395.3,
AC011663.5, AC005966.1, AC006442.1, AF004556.1, U65785.1, AC004518.1, AF045265.1, AC004237.1, AL163002.1,
Z75552.1, AL096712.20, AL022397.1, J02027.1, V01170.1, Z73477.1, AB005240.1, AB005531.1, D86408.1,
AW235646.1, AA599145.1, AW575031.1, AW851090.1, AW057979.1, AI290602.1, AA076428.1, AI937662.1,
AI025335.1, AI680594.1, AI810264.1, AA416982.1, AA252056.1,R38913.1, AW170221.1,z41148.1, AA251899.1,
R01885.1, T90448.1, AA812446.1, AW851089.1, I82954.1, AI684285.1, C21581.1, AI230413.1, AA940442.1,
AA163727.1, AI060892.1, AV428214.1, AW644211.1, AW087475.1, AW045499.1, AI976733.1, AV048357.1, U21463.1,
AA574864.1, AA365430.1, AA298325.1, AA175204.1, C17935.1, W30805.1, H86313.1, H85644.1, H06905.1, R13668.1,
P4922.1, AC036188.2, AC068190.1, AC022429.3, AL121796.4, AC021596.1, AC026129.3, AC009518.6, AC016934.4,
AC026863.3, AC068174.1, AC023845.2, AC020874.2, AL356464.3, AC044882.3, AC026004.3, AC069274.1,
AC069259.1, AC061981.2, AC034288.2, AC022101.3, AC022096.3, AC016602.5, AC010398.6, AC008842.4,
AC008950.3, AC008687.3, AC068557.1, AC068310.1, AC009440.2, AC009309.2, AC009471.3, AC019043.3,
AC011711.2, AC048354.1, AC026667.2, AC025706.3, AC015999.3, AC026819.1, AC026206.1, AC024518.2,
AC016750.4, AC021121.3, AC022773.2, AC022011.2, AC018835.3, AC007578.4, AC016394.3, AC022381.1,
AC010I65.2, AC019815.1, AC018014.1, AC006910.2, AL121928.11, AL157364.2, AL139000.3, AL135842.5,

TABLE 1-continued

Sequence homologies (GenBank Accession Numbers)

AL355335.3, AL139347.3, AL356461.1, AL356373.1, AL139424.3, AL157386.3, AL354956.1, AL353646.1, AP001983.1, AP001182.1, AP001098.2, AP000909.1, AP000877.1, AP000854.1, AP000833.1, AP000710.1,
SEQ ID NO: 318
NGO-St-141
YS1653/T3

AF220152.2, AF176646.1, AF095791.1, AB041546.1, AC009145.4, AF110520.1, U48455.1, AC007686.5, AC004000.1, AC006365.3, AC005820.1, AF135125.1, AC005519.2, AC006957.1, AL049734.11, Z84466.1, X60322.1, AA307658.1, AW295050.1, AW381667.1, AW654821.1, AW762888.1, AW062585.1, AW820659.1, AI450529.1, W40612.1, AW295045.1, AFI50311.1, AI019873.1, U49254.1, AW451671.1, AL044797.1, C93889.1, AA215860.1, AW870886.1, AW870865.1, AW286314.1, AI711921.1, AI695573.1, M450513.1, M415393.1, T46771.1, AA381620.1, AA381302.1, AA224113.1, AA036086.1, AA008214.1, AA007765.1, W41129.1, AL135793.5, AC006150.1, AC040174.2, AC027279.2, AC009451.6, AC025959.3, AC055713.2, AC048331.5, AC046170.2, AC009449.2, AC025963.2, AC016438.3, AC026894.1, AC024530.3, AC011061.4, AC010844.5, AC011318.8, AC068982.2, AC069010.1, AC025987.3, AC006534.3, ACJ068877.1, AC068837.1, AC068519.1, AC027824.2, AC068364.1, AC012272.2, AC025697.2, AC026378.4, AC055858.1, AC027031.2, AC040998.1, AC032017.1, AC023034.2, AC025 368.1, AC013786.2, AC019340.2, AC021315.1, AC015706.2, AL355366.2, AL139109.2, AL138749.7,
SEQ ID NO: 319
NGO-St-141
YS1653/T7

AF220152.2, AF176646.1, AF095791.1, T54480.1, AA197191.1, AW103791.1, AW131855.1, AW379901.1, AW856286.1, AW856267.1, AW856115.1, AW856067.1, AW815565.1, AW815555.1, AW815535.1, AW815392.1, AW815391.1, AW582306.1, AW582296.1, AW582282.1, AW391319.1, AW380346.1, AW362647.1, AI525534.1, AW815543.1, AW605996.1, AW605995.1, AW605994.1, AW605992.1, AW605991.1, AW605988.1, AW582313.1, AW582268.1, AW380347.1, AW380331.1, AW380323.1, T29399.1, W25677.1, N57107.1, AW861030.1, AW861031.1, AW753790.1, AA133029.1, AW238260.1, AL135793.5, AL353777.6,
SEQ ID NO. 320
NGO-St-142
YS1703/T3 5'

NM_003920.1, AF098162.1, AB015597.1, AIC000721.1, NM_011589.1, AF098161.1, AF071506.1, AB019001.2, AB015598.1, AF126480.1, AB019576.1, AC007043.3, AP000354.1, AC000105.41, AC011456.2, AE003430.1, NM_006118.1, AC007655.1, AC007541.9, ACZ004032.7, U20824.1, U82696.1, AL132975.1, AL132954.1, U68566.1, AL035693.19, AL022330.4, AL034552.22, AI248285.1, NC_001136.2, AC020100.4, AC016662.5, AC012679.3, NM_007682.1, NM_0017171 AC005035.1, AC007784.7, AF135787.1, AF135397.1, AF135395.1, AC007787.1, AF091398.1, AC006380.2, AC005069.2, AC006062.4, L24162.1, L19443.1, AF022365.1, U59694.1, AL049569.13, Z85996.1, Z74369.1, Z74368.1, Z26875.1, Z46796.1, Z95210.1, X55038.1, M26440.1, MI 5410.1, X68757.1, M19540.1, L03427.1, X82086.1, AW839959.1, W87879.1, AW672754.1, AW379444.1, AW840009.1, AW277013.1, AA853284.1, AW326647.1, AW658376.1, AW802270.1, AW614491.1, AW407158.1, AW343382.1, AW161333.1, AW055155.1, AI640251.1, AI494066.1, AI028107.1, AI017338.1, AA987779.1, AA550998.1, AA476555.1, AA378527.1, AA373491.1, AA348092.1, AA324524.1, AA324379.1, AA321961.1, AA216551.1, AA213579.1, W82846.1, C04452.1, C03261.1, W07180.1, W04358.1, W03539.1, W02741.1, N99738.1, N40129.1, N35204.1, N28312.1, H91970.1, R91592.1, AW485342.1, AW435759.1, AW426330.1, AW163683.1, AW013483.1, AV003759.1, AI618639.1, AI416196.1, AI201312.1, AA561002.1, D81215.1, R25330.1, AC025574.6, AC024884.6, AC009289.5, AC009056.3, AC012534.2, AC007424.20, AC024096.7, AC022438.3, AC032035.2, AC023767.3, AC020703.3, AC024418.2, AC025107.1, AC010532.2, AC010113.4, AC014387.1, AL354980.1, AL080246.13, AL121812.1, AP001652.1, AP001636.1, AP000576.2, AC018995.4, AC023130.3, AC034245.2, AC027309.2, AC010503.5, AC010862.5, AC010533.3, AC009139.5, AC023572.3, AC022217.3, AC016168.3, AC025100.2, AC009577.3, AC021762.3, AC017022.3, AC023341.3, AC015473.3, AC024019.2, A0023579.2, AC016018.7, AC023321.1, AF200455.1, AC011694.2, AL121901.18, AL136114.2, AL079336.13, AL353140.3, AL139274.6, AL160258.3, AL354822.1, AL353779.2, AL158845.2, AL157699.2, AL121715.2, AL132640.1, AC000382.1, AL139247.1,
SEQ ID NO. 321
NGO-St-142
YS1703/T7 3'

NM_003920.1, AF098162.1, AK000721.1, AL022149.2, NM_003599.1, AC009294.8, AF064804.1, AF069734.1, AF073930.1, AC004508.1, AL163285.2, AL163912.1, AL080243.21, M62354.1, AW136364.1, AI333322.1, AA809127.1, AW512259.1, AW167047.1, AW675811.1, AW418601.1, AI802251.1, AI283089.1, AI885862.1, AW769136.1, AW181883.1, AI969152.1, AI825472.1, AI494276.1, AW189438.1, AI278255.1, AA115381.1, AW731809.1, AW275265.1, AI559688.1, AI283087.1, AA679712.1, AW089758.1, AI002252.1, AW058036.1, AI696514.1, AA853283.1, T16124.1, AI446312.1, AI468188.1, AI417732.1, AA115380.1, AW134955.1, AW386251.1, AW372691.1, AW372725.1, AW386250.1, AW386246.1, AW386230.1, AW384593.1, AW373076.1, AW386279.1, AW386226.1, AW372712.1, AW151342.1, AW749244.1, AW372690.1, AW384617.1, AW373100.1, AW372711.1, AW386261.1, AI913828.1, AI887884.1, AW372727.1, AW386248.1, AW386266.1, AA564588.1, AC025574.6, AC024884.6, AC012647.15, AP000938.2, AP000894.2, AC068984.3, AC025188.3, AC020927.4, AC010621.3, AC008529.3, AC022553.2, AC037440.1, AC019231.3, AC025807.2, AC011035.3, AC023917.2, AC011898.2, AC017021.2, AC022999.1, AC011134.2, AL355873.2, AL161905.4, AJ011929.1,
SEQ ID NO. 322
NGO-St-143 combined AL1377571 NM_003683.1, U79775.1, AL163297.2, AP001752.1, AP001053.1, NM_010925.1, U79773.1, U79774.1, AF227000.1, AF102850.1, AF032922.1, AF039698.1, AF103726.1, U48696.1, AF045432.1, AF027174.1, AF033097.1, AI243486.1, S78798.1, AI249625.1, U66300.1, U39066.1, AJ004935.1, U37573.1, Z97178.1, AI010903.1, Y17148.1, U30169.1, Z49980.1, D61704.1, AF030515.1, AF061786.1, AJ277276.1, AI277275.1, AJ001103.1, U34048.1, AJ243655.2, U35663.1, YI 5421.1, AI277097.1, AI243250.1, X99051.1, AF033565.1, AJ237664.2, S83098.1, U65376.1, U52868.1, AJ242994.1, AF079586.1, AF033096.1, AF013238.1, AL163972.1, X99055.1, X65215.1, AC007193.1, TABLE 1-continued Sequence homologies (GenBank Accession Numbers)

Z92546.2, AC010793.3, AF155911.1, AC005049.2, AL163299.2, AP001754.1, AB023046.1, M22135.1, AI634547.1,
AI905810.1, AI167158.1, AI860822.1, AI362799.1, AA879460.1, AW193286.1, AA621964.1, AA113148.1, AA085786.1,
AA477106.1, AA814978.1, AI905802.1, AI160620.1, AI905797.1, AA425939.1, AI368572.1, AA135482.1, T07989.1,
L25241.1, AI905807.1, M762088.1, AI905803.1, AI905804.1, AI905811.1, AI905805.1, AI905808.1, AI905809.1,
AA931669.1, AI905800.1, F36453.1, AA135818.1, I135525.1, AW743985.1, AL022772.1, AW230615.1, AA967213.1,
AA240651.1, AA120481.1, AA072658.1, AI905822.1, AW416555.1, AA755933.1, AA870102.1, AV297071.1,
AI292030.1, AA867502.1, AV267338.1, AW356977.1, AV280340.1, W58771.1, AA674077.1, N55721.1, AW587463.1,
AA095435.1, N88018.1, AW587505.1, AV326909.1, AI816677.1, AI816676.1, AI816670.1, AI816665.1, AI816636.1,
AI816635.1, AI816630.1, AI816629.1, AI816623.1, AI816621.1, AI816617.1, AI816615.1, AI816614.1, AI816613.1,
AI816612.1, AI816606.1, AI816605.1, AI815377.1, AI815338.1, AI815337.1, AI815336.1, AA247964.1, AA249353.1,
AA247827.1, AA096046.1, AA095641.1, AA093577.1, AA092086.1, N89520.1, N83168.1, N88601.1, N84855.1,
N84830.1, N84781.1, N84718.1, N84712.1, N84048.1, N83993.1, N83992.1, N88518.1, AI816682.1, AI272402.1,
AC003656.1, AC025913.2, AC015890.2, AC010832.3, AC011550.3, AC011512.5, AC008738.5, AC005038.2,
AC023421.2, AF216667.1, AC010884.4, AC015871.1, AC019337.1, AC015860.2, AL137076.5, AC018714.3,
AC022255.3, AC026513.2, AC016883.3, AC026232.1, AC021730.3, AC024123.1, AL157896.2, AC023494.5,
AC023883.4, AC026803.2, AC025224.3, AC022327.6, AC061963.1,
SEQ ID NO. 323
NGO-St-143
YS1621/T3 5'

NM_003683.1, U79775.1, AL137757.1, AL163297.2, AP001752.1, AP001053.1, NM_010925.1, U79773.1, U79774.1,
AF227000.1, AC007746.3, AL163972.1, AC011717.4, AC007193.1, AC005988.1, AP111102.1, AF056324.1, AF063021.1,
AL162351.1, U61731.1, Z92546.2, J02027.1, v01170.1, U35655.1, Y13901.1, X05299.1, X55039.1, AP000353.2,
D87547.1, NM_002152.1, AF226868.1, AP134985.1, AF134986.1, AF227751.1, AF227750.1, AF227749.1, AF227748.1,
AF227747.1, AF227746.1, AF227745.1, AF227744.1, AP126966.1, AP126965.1, AP190860.1, AC013482.2, AF160976.1,
AF160975.1, AF124351.1, AC006917.6, AC006115.1, AC004590.1, AF019380.1, AL049780.2, AL132763.1, AL049640.1,
AJ246952.1, M60552.1, X 15539.1, X55763.1, X13484.1, AJ012324.1, AV258711.1, AA085786.1, AW226916.1,
AB012043.1, AC010793.3, NM_004758.1, AC004744.1, AF155911.1, AF039571.1, AC002375.1, AC002096.1,
AL163299.2, AL162507.1, U30378.1, AP001754.1, AP001067.1, AP000391.1, AI905810.1, AI905802.1, AI905797.1,
AA425939.1, AI905807.1, AI905803.1, M905804.1, AI905811.1, M762088.1, AI905805.1, AI905808.1, AI905809.1,
AI634547.1, AI905800.1, AA135818.1, M860822.1, H35525.1, AW743985.1, AL022772.1, AW230615.1, AA967213.1,
AA240651.1, AA120481.1, AA072658.1, AI905822.1, AW416555.1, AA755933.1, AA870102.1, AV297071.1,
AI292030.1, AA867502.1, AV267338.1, AW356977.1, AI167158.1, AV280340.1, AW193286.1, W58771.1, AI362799.1,
AA621964.1, AA931669.1, AA674077.1, AV326909.1, AA879460.1, AA814978.1, AI182664.1, AA824028.1,
AA444579.1, AA421801.1, AI272402.1, AU079997.1, AA686017.1, AV258711.1, AA085786.1, AW226916.1,
AI790508.1, AU050803.1, AA109517.1, AA071831.1, H31173.1, AW793739.1, AW653294.1, AW345388.1, AU050568.1,
AI317384.1, C93544.1, AA042339.1, AA346560.1, AA088667.1, AW831250.1, AW105116.1, AW106343.1, AI971787.1,
AI235030.1, AI231939.1, AI136718.1, AA239586.1, Z74657.1, AW239596.1, AC003656.1, AC025913.2, AC015890.2,
AC010832.3, AC011550.3, AC008738.5, AC005038.2, AC046197.2, AC023421.2, AF216667.1,
AC005289.15, AC005141.1, AL139241.4, AL121895.21, AC051652.2, AC069160.1, AC018714.3, AC026513.2,
AC016883.3, AC012350.3, AC026232.1, AC021730.3, AC024123.1, AC017113.3, AL157896.2, AL0317726,
AC023494.5, AC023883.4, AC025177.3, AC008891.6, AC010001.29, AC021107.2, AC022327.6, AC061963.1,
AC025086.2, AF235106.1, AC037447.1, AC021491.3, AC023327.3, AC019264.3, AC011432.2, AC018802.3,
AC024916.1, AC020827.2, Z95330.10, AL157877.5, AC069141.1, AC024116.10, AC068663.1, AC068438.1,
AC012115.2, AC026657.3, AC046148.2, AC003059.11, AC012540.2, AC034254.1, AC032012.1, AC015705.3,
AC012399.16, AC020836.1, AC020971.1, AC023174.1, AL121581.19, AL355598.3, AL133401.15, AL133317.5,
AL356104.1, AL158169.1,
SEQ ID NO. 324
NGO-St-143
YS1621/T7 3'

AL137757.1, AL163297.2, AP001752.1, AP001053.1, NM_003683.1, U79775.1, NIVI_003830.1, AC007633.3,
AP170484.1, U71383.1, AL109953.24, AL161831.1, AL161586.2, AL16151S.2, AL079347.1, U32186.1, AC006920.10,
AC005560.2, AE003552.1, AE003551.1, AE003542.1, AC005774.1, AP170972.1, AC009895.2, AC005049.2,
AF017257.1, AL163277.2, AL049795.20, AL031588.1, AL031848.11, L34771.1, U46669.1, AP001732.1, AP001040.1,
AB023046.1, AI634547.1, AI167158.1, AI860822.1, AI362799.1, AA879460.1, AW193286.1, AA621964.1, AA113148.1,
AA085786.1, AA477106.1, AA814978.1, AI160620.1, AI368572.1, AA135482.1, T07989.1, L25241.1, AI762088.1,
AA425939.1, AA931669.1, P36453.1, AA135818.1, AI155506.1, AA386906.1, Z81226.1, W89417.1, AA049595.1,
AW819008.1, AW812918.1, AW812808.1, AW651237.1, AW651235.1, AW182071.1, AV367551.1, AW118908.1,
ALL21132.1, AI760754.1, AU050523.1, AU069491.1, AI538204.1, AI301191.1, AI204164.1, AI192033.1, AI188040.1,
AI005113.1, AI004282.1, AI001990.1, AA829448.1, AA808355.1, AA805773.1, AA805770.1, AA805757.1, AA578718.1,
AA461396.1, W49126.1, N42521.1, H77382.1, H69418.1, R83544.1, AC003656.1, AC010832.3, AC069214.1,
AC011121.4, AC022255.3, AC019225.2, AC025865.2, AL160006.2, AC021886.4, AC025224.3, AC044866.1,
AC018755.2, AC024514.2, AC006433.14, AC008764.6, AC020907.3, AC020553.3, AC023169.3, AC026279.3,
AC016207.4, AC010958.3, AC026392.2, AC026226.1, AC010751.3, AC010698.4, AC010043.4, AC015977.3,
AC020578.3, AC014376.1, AC014962.1, AC020215.1, AC010107.5, AC010566.2, AL121991.4, AL354000.2,
AL137077.4, AL158217.3, AL035362.1, Z96802.1, AP001522.1,
SEQ ID NO. 325
NGO-St-144
YS273/T3 5'

AF134726.1, AP000502.1, AP109906.1, AC004491.1, U95738.1, AC004169.3, AC004702.1, Z97206.1, AE003627.1,
AE003462.1, AP207857.1, AP220606.1, AP167431.1, AP175708.1, AC007258.3, AP123049.1, AC005747.1, AC005734.1,
AF065393.1, AC004642.1, AC003112.1, AL096814.26, AL031658.1,1, AL050342.42, AL034548.25, AL031291.3,
Z98304.1, AL031055.1, AL031848.11, X00171.1, M27063.1, Z62533.1, M83563.1, AI828004.1, AA934369.1,
AA284078.1, AI363412.1, AA825937.1, AI693027.1, AW135103.1, N32981.1, M380588.1, AA889484.1, AW849473.1,
AA281771.1, AW452548.1, AI056156.1, AI198369.1, AA888916.1, AA865127.1, AW499959.1, AI979291.1, AI570702.1,

TABLE 1-continued

Sequence homologies (GenBank Accession Numbers)

AA768957.1, AI916722.1, AA804213.1, AA885368.1, AW489464.1, AW434474.1, W53342.1, AA822514.1, AA017911.1,
AV420901.1, AV414577.1, AW297734.1, AW086516.1, AI399628.1, AI297948.1, AI294501.1, AI255938.1, AA513205:1,
AA179371.1, AA145014.1, W63826.1, AL139040.4, AC013751.3, AC068591.1, AC018720.3, AC015940.2, AC025843.2,
AC015931.4, AC015801.3, AC009558.3, AC010959.3, AC008088.2, AC018665.2, AC018521.1, AL161638.2,
AC063954.2, AC036174.2, AC068728.3, AC022420.3, AC010484.3, AC008439.3, AC032019.2, AC018644.3,
AC009220.7, AC011443.4, AC031998.2, AC022285.5, AC062029.1, AC026591.2, AC022227.6, AC025707.3,
AC040955.1, AC026154.3, AC025931.2, AC013345.3, AC013328.5, AC015670.4, AC015988.3, AC025590.2,
AC026471.1, AC020560.2, AC020706.3, AC011165.3, AC011798.3, AC023022.1, AC012489.3, AF214634.1,
AC020183.1, AC020509.1, AC009849.6, AC005124.2, AL356464.1, AL122034.8, AL353092.3, AL162255.5,
AL121747.21, AL355314.1, AL354714.2, AL158217.3, AP001491.1,
SEQ ID NO. 326
NGO-St-144
YS273/T7 3'

AP134726.1, AP000502.1, AC003037.1, AC002040.1, AC006449.19, AC002044.1, AC004129.1, AC006441.13,
AC002351.1, AF030876.1, AC005757.1, AC005620.1, AC004583.1, AF031078.1, AF223391.1, U96629.1, AC009516.19,
AC005921.3, AP001052.1, AP000553.1, L48038.2, AC002059.3, AC000026.3, AF121781.1, AL163279.2, AC002326.1,
AL009031.1, AC007956.5, AC006387.3, AC004098.1, AL133355.12, AC005015.2, AC005519.2,
AP000184.1, AP000040.1, AP000282.1, AP000108.1, U91321.1, AC003959.1, AL163215.2, AL135749.2, AD000864.1,
L78810.1, Z93023.1, AL009172.1, AP001670.1, AC004668.1, AC003086.1, AC004465.1, AC004132.1, AC003684.1,
AL121749.13, AC005067.2, AL035045.2, AC005057.2, AC004.687.1, U62293.1, AF196971.1, AC006544.19,
AC004382.1, AC006254.10, AL050307.13, Z86064.1, Z97054.1, AL031276.1, AL109798.19, AP000283.1, AC002126.1,
AC003010.1, AL031848.11, Y07848.1, AC006111.2, U82828.1, AL023584.1, AF038458.1, U93037.1, AL031311.1,
AC011455.6, AC005295.1, AC005104.1, AC004253.1, AL121809.4, AC006930.1, AL136418.2, AL139054.1,
AL078644.10, AL022237.1, AA284189.1, AW338381.1, AA568535.1, AA579064.1, AA281850.1, AA994641.1,
AW794982.1, AA857326.1, AL036622.1, N89207.1, AW591633.1, AW166629.1, AW088364.1, AI076062.1,
AA748058.1, AA704850.1, AA570496.1, AA371011.1, AA044796.1, AA044741.1, M77904.1, AW081071.1, AI631359.1,
AI580045.1, AI471805.1, M469586.1, AI282705.1, AA854983.1, AA644545.1, AA503615.1, AA486925.1, AW875776.1,
AW794828.1, AW193880.1, AI242847.1, AI085078.1, AI032984.1, AA812987.1, AA745404.1, AA482685.1,
AA4.60896.1, AA377927.1, AA174138.1, AA059338.1, W01949.1, N21111.1, AW409692.1, AI051697.1, AA974475.1,
AA579437.1, AA580000.1, AA564343.1, AA465689.1, AA338281.1, AW518364.1, AW373785.1, AW135699.1,
M798136.1, AI696117.1, AI475231.1, AI339498.1, AI168274.1, AI025850.1, AI017159.1, AA657377.1, AA614340.1,
AA557393.1, AA525157.1, AA504723.1, N31583.1, N21688.1, T52837.1, AA507035.1, AA317869.1, AI223321.1,
AA742637.1, H73550.1, T90362.1, H60462.1, H50970.1, AI679747.1, AI332671.1, AI014798.1, AW855113.1,
AW086361.1, AI862231.1, AI792627.1, AI792525.1, AI349662.1, AI348722.1, AI254439.1, AI053903.1, AI053450.1,
AA594091.1, AI469598.1, AW105737.1, AA830169.1, AW316747.1, AW836527.1, AA826285.1, AL139040.4,
AL356352.2, AC067952.3, AL096887.7, AL160175.4, AC015904.3, AC016636.4, AC011461.2, AC009019.4,
AC008732.4, AC024156.2, AC022037.1, AP000921.2, AP000571.1, AC008267.3, AC018506.3, AC016289.3,
AL353653.5, AL354681.1, AC015551.9, AC023121.3, AC023970.2, AC027572.2, AC011152.4, AC011134.2,
AC016703.3, AP000761.1, AP000685.1, AC008731.4, AC019207.3, AC017093.2, AU54656.1, AP001381.1,
AC055815.2, AC026419.2, AC011495.3, AL162415.2, AC021836.3, AC018500.2, AL353712.2, AL158169.1,
AL138798.2, AC021590.3, AC013691.3, AC012364.3, AC021565.1, AC008922.5, AC016916.4, AC021194.2,
AC046135.4, AL159989.3, AL161672.2, AL138788.1, AC025164.7, AC046826.2, AC016675.4, AC009362.5,
AC011477.3, AC009073.5, AC027372.2, AC023959.2, AC012182.3, AL139226.14, AC046176.2, AC016736.3,
AL136360.7, AC010742.3, ACJ013797.2, AL109743.3, AC011484.2, AC026170.1, AC012433.5, AC026022.2,
AC011499.2, AC032015.2, AC026300.2, AC026634.2, AC009335.2, AC022951.Z AL355001.3, AL137849.2,
AC044819.2, AC020757.2, AL121926.16, AL354693.1, AC025918.3, AC012659.3, AC011785.3, AL160009.3,
AL139022.1, AC007939.2, AL354745.3, AL139132.4, AL354808.3, AJ132411.1, AC044817.2, AC025090.2, AC013275.4,
AP000668.1, AC009110.5, Z83844.5, AL031672.12, AL033376.17, AC002045.1, AC005377.2, AC006509.15,
AC005071.2, AC005940.3, AC007029.3, AL050350.14, AC004506.1, Z82206.1,
SEQ ID NO. 327
NGO-St-145
YS1411/T3 5'

AL133161.1, AK001729.1, AC002301.1, AC005343.1, AC003669.1, Z50797.1, AC006991.2, AE003795.1, AC012302.5,
AC009947.2, AC000065.1, NM_008448.1, AC005998.3, AC005275.1, AC004311.1, AC005771.1, U40856.1,
AC004505.1, AF069716.1, AF039716.1, AL161496.2, U86090.1, Z82190.1, Z70273.1, Z94056.1, AI248283.1, U29523.1,
X81852.1, AP000067.1, M11797.1, L27153.1, AL047720.2, AW815677.1, AW668623.1, AI307523.1, AW786510.1,
M426794.1, AI729581.1, AA460639.1, AW312313.1, AI793025.1, AI792241.1, AI765078.1, AA914152.1, AW729381.1,
AW469634.1, AU082430.1, AU082418.1, AV362112.1, AV327711.1, AI894213.1, M892798.1, AI812413.1,
AV149849.1, AI682199.1, AI649596.1, AI293042.1, AI190544.1, AI135558.1, AU017449.1, AU017158.1, AI01454.6,1,
C86411.1, AA711482.1, AA692780.1, AA692302.1, AA671345.1, AA655714.1, C56496.1, AA415524.1, AA097087.1,
AA087538.1, AA087381.1, H33004.1, AL353736.1, AC012445.3, AC009133.5, AC023831.3, AL139284.3, AC068045.1,
AC017108.2, AC010746.3, AL355577.2, AL161891.6, AL160394.4, AL121939.3,
SEQ ID NO. 328
NGO-St-145
YS1411/T7 3'

AL133161.1, AK001729.1, AF087969.1, AP177478.1, AL159179.2, AL049835.3, AL096851.1, AC007252.2, AFO81241.1,
AC008125.9, AF135183.1, AC004704.2, AC005937.1, AC003024.1, U71587.1, AE000904.1, AJ271161.1, U43282.1,
U41530.1, AB042823.1, AP000511.1, AB023048.1, AJ007958.1, AL043584.1, AI131161.1, AL047721.1, AI074999.1,
AI369743.1, AI191659.1, AI752102.1, AI804688.1, H70039.1, W63623.1, AA412273.1, AA345937.1, AA461564.1,
AA346011.1, W39608.1, AA046569.1, AL045395.1, AA412608.1, H70038.1, AW263032.1, AA534737.1, AI854609.1,
AU024381.1, AI235913.1, AW556867.1, AI464166.1, AI862154.1, AW195190.1, AW532431.1, AW134839.1,
AI632675.1, AI333447.1, AW070552.1, AA776248.1, AI033598.1, AI492046.1, AI560827.1, AI990263.1, AI090658.1,
AW131196.1, AI337152.1, AA962117.1, AA216415.1, AI377836.1, AI032741.1, AI381470.1, AW182779.1, AA137689.1,
AA865536.1, AA632347.1, W61524.1, AI307523.1, W88673.1, AI278969.1, H30866.1, AA460639.1, AW336387.1,

TABLE 1-continued

Sequence homologies (GenBank Accession Numbers)

R94150.1, AW499467.1, AA294458.1, AI401456.1, AA432615.1, AV390623.1, AW580849.1, AW580825.1,
AW336569.1, AW336391.1, AW257455.1, AW217194.1, AV264232.1, AI439888.1, N53539.1, AL353736.1,
AC010736.4, AC023254.3, AC061993.2, AC024232.2, AC025734.2, AL139125.3, AL158046.1,
SEQ ID NO. 329
NGO-St-145
YS144/T3 5'

AL133161.1, AK001729.1, AC005343.1, Z50797.1, NC_001142.1, AE003727.1, AE003462.1, AF223391.1, AC004662.1,
AC004254.1, AC006820.1, AC024205.1, NM_007046.1, NM_006521.1, AF162780.1, NM_008448.1, AF207550.1,
AF196779.1, AF088916.1, AC005275.1, AF049895.1, AE000113.1, AF068862.1, AC003694.1, AF070717.1, AF069716.1,
AC004642.1, L43549.1, AL163239.2, AL133332.12, AL161985.1, AL161496.2, U86090.1, AL050138.1, Z70273.1,
U29523.1, Z49452.1, D87675.1, AP001694.1, X97162.1, X96717.1, X51330.1, AP001443.1, AP00I40.1, AB011100.2,
AP000088.1, X54945.1, D10483.1, L27153.1, AL045394.1, AL047720.2, AW815677.1, AW447609.1, AW418275.1,
AI426794.1, AW668623.1, AA087606.1, AI380050.1, AA914152.1, AW774428.1, AW736393.1, AW649599.1,
AW586591.1, AL138309.1, AI892798.1, AI739806.1, AA711482.1, AA692780.1, AA692302.1, AA671345.1,
AA655714.1, AA415524.1, AA119710.1, AA097087.1, AA087538.1, AA087381.1, H33004.1, R50279.1, AL353736.1,
AC012445.3, AC011030.4, AC009564.4, AC051613.3, AL132672.7, AP000478.2,
SEQ ID NO. 330
NGO-St-145
YS144/T7 3'

AL133161.1, AK001729.1, AF087969.1, AP177478.1, AL159179.2, AL049835.3, AC006222.1, AC007252.2,
AF081241.1, AC008125.9, AF135183.1, AC004704.2, AC005937.1, AC005180.1, U71587.1, AE000904.1, AI271161.1,
U43282.1, U41530.1, AB042823.1, AP000511.1, AB023048.1, AL043584.1, AI131161.1, AL047721.1, AI074999.1,
AI369743.1, AI191659.1, AI752102.1, AI804688.1, W63623.1, K70039.1, AA412273.1, AA345937.1, AA461564.1,
W39608.1, AA346011.1, AA046569.1, AL045395.1, AA412608.1, H70038.1, AW263032.1, AA534737.1, AI854609.1,
AU024381.1, AI235913.1, AI464166.1, AW556867.1, AI862154.1, AW195190.1, AW532431.1, AW134839.1,
AI632675.1, AI333447.1, AW070552.1, AA776248.1, AI033598.1, AI492046.1, AI560827.1, AI307523.1, AI990263.1,
AI090658.1, AW131196.1, AI337152.1, AA962117.1, AA216415.1, AI377836.1, AI032741.1, AI381470.1, AW182779.1,
AA865536.1, AA137689.1, AA632347.1, W61524.1, AA460639.1, W88673.1, AI278969.1, H30866.1, AW336387.1,
R94150.1, AA432615.1, AW499467.1, AA294458.1, AV390623.1, AI598316.1, AI401456.1, AW706903.1, AW580849.1,
AW580825.1, AW257455.1, AW217194.1, AV264232.1, AI950381.1, W28723.1, N53539.1, H60201.1, H60196.1,
R45124.1, R19599.1, R19570.1, AL353736.1, AC010736.4, AC023254.3, AC061993.2, AC021751.11, AC011448.2,
AC025792.2, AC025734.2, AC023932.2, AL139125.3, AL158046.1, AP001127.1,
SEQ ID NO. 331
NGO-St-145
YS278/T3 5'

AL133161.1, AK001729.1, NM_008958.1, AB028866.1, AB010833.1, NM_014726.1, AF217796.1, AC002432.1,
AC002303.1, AF077302.2, AC007298.17, AC005520.2, AP112866.1, U60822.1, AC004233.1, AL135752.2, AJ131018.1,
AL096699.11, U10895.1, AK001621.1, A8018318.1, AW500657.1, AW673603.1, AW868998.1, AW869117.1,
AI608224.1, AA387916.1, AW288019.2, AW654284.1, AW493485.1, AW487305.1, AW487276.1, AW461989.1,
AW437959.1, AW403475.1, AW319454.1, AW239228.1, AW239051.1, AW217284.1, AV215050.1, AV205 793.1,
AV155082.1, AV166903.1, AV152358.1, AV137501.1, AV123651.1, AV120391.1, AV117483.1, AV101080.1,
AV098121.1, AV091752.1, AV084455.1, AV083583.1, AI763878.1, AV061031.1, AV060485.1, AV058197.1,
AV057140.1, AV056958.1, AV055574.1, AI713124.1, AV006753.1, AI575485.1, AI527477.1, AI012556.1, AI179780.1,
AI175786.1, AI119288.1, AI112286.1, AI111977.1, AI111490.1, AI072849.1, AI071746.1, AA874227.1, AA810909.1,
AA797102.1, AA616728.1, AA445862.1, AA278495.1, AA182075.1, AA145911.1, AA072792.1, AA059888.1,
AA047908.1, AA041963.1, AA032369.1, AA003397.1, H61508.1, AL353736.1, AC012683.3, AC023955.2, AC018698.4,
AC047322.1, AC049120.1, AC025999.3, AC019264.3, AC025655.2, AC010754.2, AL160235.1, AP001202.1,
AC021048.8, AC024727.4, AC068810.1, AC025643.3, AC068488 1, AC019093.3, AC022842.4, AC023593.3,
AC010268.3, AC019129.3, AC018673.3, AC025424.3, AC027044.2, AC021421.2, AC024731.5, AC013543.4,
AC036147.1, AC024883.3, AC027777.1, AC021323.2, AC025133.2, AC020994.5, AC023658.1, AC016777.3,
AF202962.1, AC013679.1, AC005054.1, AL162714.4, AL121845.18, AL121880.15, AP001556.1, AP001368.1,
AP000834.1, AP000757.1, AP000683.1,
SEQ ID NO. 332
NGO-St-145
YS278/T7 3'

AF087969.1, AL133161.1, AK001729.1, AF177478.1, AL159179.2, AL049835.3, U40830.1, Z97055.1, AI238394.1,
X61677.1, M90087.1, AC004981.1, AF081241.1, AF135183.1, AC004704.2, AF064857.1, AL163281.2, AJ271161.1,
Z82077.1, U43282.1, U41530.1, X89886.1, AB042823.1, AL045395.1, AW263032.1, AA534737.1, AI862154.1,
AW195190.1, M333447.1, AW070552.1, AI632675.1, AI492046.1, AI033598.1, AA776248.1, AI560827.1, AI090658.1,
AI990263.1, AI337152.1, AW131196.1, AI377836.1, AI381470.1, AI032741.1, AA216415.1, AW182779.1, AA962117.1,
W63623.1, AA632347.1, AI278969.1, AA865536.1, AI401456.1, AI439888.1, W88673.1, AW028469.1, AA810290.1,
AL047721.1, AA725456.1, AI074999.1, AI752102.1, AI191659.1, AI131161.1, AA412273.1, AI369743.1, AI699071.1,
AI804688.1, AA461564.1, AW611821.1, AW083337.1, AL043584.1, AA620499.1, H70039.1, H27907.1, AI991681.1,
W15240.1, AI684348.1, AI424392.1, AA229511.1, AA345937.1, AA046704.1, AA346011.1, AI608926.1, AI492935.1,
AA447104.1, AI235913.1, AU024381.1, M854609.1, AI464166.1, AW556867.1, AW532431.1, AW134839.1,
AW747938.1, AA962117.1, AA557671.1, AA137689.1, W61524.1, AA972005.1, W39608.1, H30866.1, H70038.1,
AW336387.1, R94150.1, AW499467.1, AA294458.1, BB000336.1, AW580849.1, AW580825.1, AW257455.1,
AW217194.1, AV274485.1, AV264232.1, AW152551.1, AV046353.2, AI503741.1, C99210.1, AA795526.1,
C79929.1, AA607081.1, AA508474.1, AA248433.1, N53539.1, R29422.1, AL353736.1, AC010736.4, AL356241.2,
AC061993.2, AC032025.2, AC027704.2, AC013712.3, AC022868.4, AC025734.2, AL139231.4, AL139125.3,
AL158046.1, AC015551.9, AC062004.2, AC024895.5, AC023757.4, AC068652.1, AC044787.3, AC016567.4,
AC009220.7, AC021091.2, AC009061.8, AC032021.2, AC068066.1, A0023041.2, AC009994.4, AC027480.2,
AC009551.4, AC062039.1, AC027682.2, AC019243.3, AC024974.2, AC019214.2, AC012429.4, AC023264.2,

TABLE 1-continued

Sequence homologies (GenBank Accession Numbers)

AC018689.2, AC012594.3, AC011138.2, AC012050.1, AL356242.2, AL356100.1, AL157905.2, AL022597.5, AP001910.1, AP001260.1, AP001093.2, AP000743.1, Z92865.1,
SEQ ID NO. 333
NGO-St-146
YS358/T3 5'

AC006038.2, NM_004434.1, U97018.1, AC002094.1, NM_013589.1, AC018632.1, AC005881.3, AC007887.8, AF128394.1, AC006121.1, AL163203.2, AF004874.1, AL139078.2, AL050302.2, AL049911.2, U14611.1, AB019224.1, AB026642.1, X15122.1, Y00398.1, X02806.1, D00216.1, K02646.1, AE003844.1, AC004901.1, AF125520.1, AF017299.1, Z54281.1, Z68217.1, AL035562.14, U40426.1, AK000952.1, Z81167.1, AW851191.1, AW851190.1, AW342912.1, AW306072.1, AL041588.1, AW683786.1, AW483175.1, AW471804.1, AW471754.1, AW433049.1, AW397869.1, AW397864.1, AW397818.1, AW397808.1, AW397328.1, AW397299.1, AW397225.1, AW397183.1, AW397082.1, AW396931.1, AW396867.1, AW395710.1, AW395684.1, AW395670.1, AW318300.1, AW318207.1, AW318175.1, AW318001.1, AW317912.1, AW317798.1, AW317683.1, AI941128.1, AI941087.1, AI940932.1, AI940896.1, M795036.1, AI748210.1, AI735897.1, AI735879.1, AI735805.1, AI735804.1, AI736030.1, AI629905.1, AU024702.1, AU024209.1, AA766572.1, AA760753.1, AA501257.1, AA501255.1, T08982.1, AC013322.5, AL133368.1, AC025644.2, AC021799.1, AC013567.2, AL138963.4, AL138693.6, AC027399.2, AC007445.2, AC016201.5, AC022035.2, AC017091.3, AF215845.1, AP001402.1, AC036149.2, AC025524.2, AC021486.3, AC019188.3, AL355301.3, AL158201.7, AL158031.4,
SEQ ID NO. 334
NGO-St-146
YS358/T7 3'

AC006038.2, AF131753.1, Z82268.1, Z94721.1, AC002074.1, AC006377.3, AL161532.2, AL049500.1, AF114156.1, AE003579.1, AC004111.1, AC006040.2, AC005075.2, AF125448.1, AC005149.1, AC002416.1, AF006762.1, AL117694.3, AC005826.1, AC006956.15, AC004668.1, AC015445.3, AC004862.1, AC006379.2, AL163232.2, U56964.1, AL035634.7, U40410.1, AB022157.1, AP001687.1, AP001253.1, X83624.1, AC007590.1, AF070718.1, AL161536.2, AL110482.1, J04485.1, AL080250.11, AL031677.5, AL031599.1, AL049487.1, AL049656.1, U41545.1, AW173156.1, AW419091.1, AI240374.1, AI806503.1, AW152350.1, AW276130.1, AA449115.1, AW516027.1, AI290977.1, AI803121.1, AI192373.1, AI193573.1, AA587244.1, AI288196.1, AA977076.1, AI367149.1, AA421771.1, AI910966.1, AI343706.1, AI499018.1, AA927517.1, AW445056.1, AI130998.1, AW771159.1, AW592577.1, AW097006.1, AI864290.1, AI097567.1, AI884377.1, N94895.1, AW511972.1, AI305161.1, AI304601.1, AW079658.1, AW044403.1, AW768529.1, AW151869.1, AA193343.1, AI341554.1, AI290345.1, AA193461.1, AA861909.1, AA527518.1, N29071.1, AI277874.1, AI027217.1, AA459958.1, AA716610.1, AI051389.1, AA836942.1, AA679242.1, AA553698.1, AA082407.1, AI873933.1, R38955.1, AW272553.1, AA865858.1, AA832468.1, AA417893.1, N27375.1, D11610.1, AI867049.1, AA917795.1, AA256313.1, AA034164.1, N48340.1, H10359.1, AW119101.1, AA256438.1, N23618.1, AI240601.1, AA514495.1, AI290297.1, AI061272.1, AA443213.1, AA789034.1, H08100.1, R40145.1, D12463.1, AA482526.1, AI240093.1, AA493130.1, AA122021.1, AA994372.1, AW514004.1, AI523990.1, R84780.1, AA227683.1, H06663.1, X91713.1, AA062803.1, AA585119.1, AA890144.1, AI283724.1, AA056271.1, AI634524.1, AI644019.1, AW556280.1, AW142557.1, AW550088.1, AC013322.5, AL355365.2, AL354880.3, AP000621.1, AC027141.1, AL133458.12, Z93243.1, Z83124.1, AC012022.5, AC068296.4, AC066601.1 AC007481.2, AC016775.4, AC015473.3, AC019993.1, AL157955.1, AC067723.2, AC025164.7, AC027301.3, AC007683.3, AC026087.3, AC015625.3, AL355542.2, AL136301.4, AP001965.1, AC016255.8, AC055821.2, AC058803.1, AC026233.2, AC024181.2, AC022087.3, AC022796.3, AC006280.6, AC018594.3, AC016255.7, AL138823.3, AL096784.2,
SEQ ID NO. 335
NGO-St-146
YS112/T3 5'

AC006038.2, NM_012155.1, AF103939.1, AL096717.1, NM_004434.1, U97018.1, AE003673.1, AE001573.1, AC001655.1, NM_008519.1, NM_0060071 AF077673.1, AF062072.1, AFJ10104.1, AC006121.1, AF044030.1, AF062347.1, AF062346.1, AC003029.1, AC004226.1, U14611.1, D84515.1, AE003596.1, AC005191.1, AC007077.2, AF017299.1, Z96811.2, AL035562.14, U40455.1, AA983842.1, Z81167.1, AA681706.1, AI596558.1, AA465739.1, AA850758.1, AW593841.1, AW516768.1, AW475067.1, AW303490.1, AW188604.1, AI807190.1, AI767422.1, AI740707.1, AI739199.1, AI582285.1, AI473581.1, AI458952.1, AI376302.1, AI312515.1, AA775264.1, AA743080.1, AA428244.1, AA352385.1, AA043549.1, AW637997.1, AW631275.1, AW630845.1, AW483175.1, AW361213.1, AL134742.1, AA410201.1, AA298178.1, AA298197.1, AA233347.1, AA228021.1, AA165101.1, AA035737.1, AA002175.1, W73050.1, N28928.1, D56390.1, D58486.1, H04632.1, R56367.1, R33003.1, R24775.1, F05590.1, T30904.1, Z42327.1, AW608299.1, AI903729.1, AV135789.1, AI629905.1, AU024209.1, AA648943.1, AA532311.1, T50574.1, AC013322.5, AC011480.2, AL049868.12, AL133368.1, AC022575.9, AC020282.1, AC063945.3, AC068051.2, AC068642.2, AC062020.2, AC067870.1, AC024948.2, AC007445.2, AC020684.4, AC022986.3, AC021885.3, AC018864.4, AC022451.1, AF215845.1, AL160266.6, AL135924.10, AC068130.2, AC069220.1, AC046133.3, AC068545.2, AC055837.2, AC036149.2, AC026720.3, AC010477.6, AC008384.4, AC008562.3, AC064860.2, AC027581.2, AC012213.3, AC016881.4, AC006400.6, AC009609.5, AC036233.1, AC025370.2, AC025090.2, AC021463.2, AC022247.2, AC016169.3, AC016690.4, AC021877.4, AC013638.3, AC010940.3, AC015567.3, AC019239.3, AC007873.4, AC008086.2, AC019047.2, AC024171.1, AC011997.3, AC013885.1, AC013401.1, AC015691.1, AC012116.1, AC000016.1, ALL21952.6, AL354498.2, AL158210.6, AL158043.4, AL136992.18, AP001554.1, AP001484.1, AP001375.1, AP000834.1, AP000757.1,
SEQ ID NO. 336
NGO-St-146
YS112/T7 3'

AC006038.2, AF131753.1, Z82268.1, AL161532.2, AL049500.1, AF114156.1, AE003579.1, AC004111.1, AC006040.2, AC005075.2, AF125448.1, AC005149.1, AC002416.1, AF006762.1, AC005826.1, AC006956.15, AC004668.1, AC002074.1, AC015445.3, AC005344.1, AL1632322, U56964.1, Z68296.1, AL035634.7, U40410.1, AB022157.1, AP001687.1, AP001253.1, X83624.1, AC004554.1, AL110482.1, AL133279.2, AL122021.3, AC000118.1, AL031677.5, AL009047.1, AL049487.1, AW173156.1, AW276130.1, AW419091.1, AI806503.1, AW15f150.1, AA449115.1, AI240374.1, AW516027.1, AI290977.1, AI193573.1, AI803121.1, AI192373.1, AA587244.1, AI288196.1, AI367149.1,

TABLE 1-continued

Sequence homologies (GenBank Accession Numbers)

AA977076.1, AI910966.1, AI499018.1, AA421771.1, AW445056.1, AI343706.1, AA927517.1, AI130998.1, N29071.1, AI097567.1, AW592377.1, AW771159.1, AW079658.1, AI864290.1, AI304601.1, AI097006.1, AW044403.1, AI305161.1, AW511972.1, AI884377.1, N94895.1, AW768529.1, AW151869.1, AA193343.1, AA193461.1, AI290345.1, AI341554.1, AA527518.1, AI277874.1, AA861909.1, AI027217.1, AI051389.1, AA459958.1, AA716610.1, AA836942.1, AA082407.1, AA679242.1, R38955.1, AA865858.1, AA553698.1, AA256438.1, AI873933.1, AW272553.1, AA832468.1, AA417893.1, AI867049.1, AA482526.1, AA256313.1, AA034164.1, N27375.1, D11610.1, AA917795.1, AW119101.1, N48340.1, H10359.1, AI240601.1, AI290297.1, AA514495.1, N23618.1, AA789034.1, H08100.1, AI061272.1, AA443213.1, R40145.1, D12463.1, AI240093.1, AA493130.1, AA227683.1, AA122021.1, AW514004.1, AA994372.1, AI523990.1, R84780.1, AI634524.1, H06663.1, X91713.1, AA062803.1, AA585119.1, AI283724.1, AA890144.1, AA056271.1, AI644019.1, AW556280.1, AW142557.1, AW550088.1, AC013322.5, AL355365.2, AL354880.3, AP000621.1, Z93243.1, Z83124.1, AC027141.1, AC012022.5, AC068296.4, AC007481.2, AC015473.3, AC019993.1, AC006876.1, AC067723.2, AC025164.7, AC027301.3, AC007683.3, AP001965.1, AC016255.8, AC055821.2, AC025920.8, AC024162.2, AC058803.1, AC026233.2, AC018555.3, AC021381.3, AC024181.2, AC022087.3, AC022796.3, AC006280.6, AC019111.3, AC016255.7, AC012410.2, AC012105.1, AL049184.5, AL096784.2,
SEQ ID NO. 337
NGO-St-146
YS266/T3 5'

AC006038.2, NM_004434.1, U97018.1, AC002094.1, NM_013589.1, AC018632.1, AC005881.3, AC007887.8, AF128394.1, AL163203.2, AF004874.1, AL161498.2, AL139078.2, AL050302.2, AL049911.2, AB019224.1, AB026642.1, X15122.1, Y00398.1, X02806.1, D00216.1, K0264.6,1, AE003844.1, AE003524.1, AC004901.1, AF125520.1, AC006121.1, AL079352.3, Z54281.1, Z68217.1, AL035562.14, U40426.1, AW851191.1, AW851190.1, Z81167.1, AW851162.1, AW504697.1, AW342912.1, AW306072.1, AL041588.1, AW683786.1, AW471804.1, AW471754.1, AW433049.1, AW397869.1, AW397864.1, AW397818.1, AW397808.1, AW397328.1, AW397299.1, AW397225.1, AW397183.1, AW397082.1, AW396931.1, AW396867.1, AW395710.1, AW395684.1, AW395670.1, AW3.1, 8300.1, AW318207.1, AW318175.1, AW318001.1, AW317912.1, AW317798.1, AW317683.1, AI941128.1, AI941087.1, AI940932.1, AI940896.1, AI795036.1, AI748210.1, AI735897.1, AI735879.1, AI735805.1, AI735804.1, AI736030.1, AU024702.1, AU024209.1, AA766572.1, AA760753.1, AA501257.1, AA501255.1, T08982.1, AC013322.5, AL133368.1, AC025644.2, AC021799.1, AC013567.2, AL138963.4, AC022275.9, AC027399.2, AC026927.2, AC023790.5, AC067752.2, AC007445.2, AC022035.2, AF215845.1, AC017592.1, AC013559.2, AP001402.1, AC069220.1, AC036149.2, AC025524.2, AC024288.2, AL355301.3, AL158201.7, AL158031.4,
SEQ ID NO. 338
NGO-St-146
YS266/T7 3'

AC006038.2, AF131753.1, AC004531.1, AF114156.1, AE003579.1, AC004111.1, AC006040.2, AF125448.1, AC005149.1, AC002416.1, AF006762.1, AC006956.15, AF222718.1, AC015445.3, U23516.2, AC003035.1, AC004470.1, AC002070.1, U56964.1, Z66495.1, Z68296.1, AL035634.7, U40410.1, U29376.1, AB022157.1, X83624.1, AC016972.5, AC005075.2, AC007590.1, AF096373.1, AL161516.2, AL110482.1, AC031677.5, AL031599.1, AL049487.1, U41545.1, AW173156.1, AW276130.1, AI806503.1, AW419091.1, AW152350.1, AI240374.1, AA449115.1, AW516027.1, AI290977.1, M193573.1, AI803121.1, AI192373.1, AA587244.1, M288196.1, AA977076.1, AI367149.1, AI910966.1, AI499018.1, AA421771.1, AW445056.1, AI343706.1, AA927517.1, AI130998.1, AI097567.1, AW771159.1, N29071.1, AW592377.1, AI864290.1, AI304601.1, AI097006.1, AW511972.1, AW044403.1, AI884377.1, AI305161.1, N94895.1, AW768529.1, AW079658.1, AW151869.1, AA193343.1, AI341554.1, AA193461.1, AI290345.1, AA527518.1, AI277874.1, AA861909.1, AI027217.1, AI051389.1, AA459958.1, AA716610.1, AA836942.1, AA679242.1, AA082407.1, AA256438.1, R38955.1, AA865858.1, AA553698.1, M873933.1, AW272553.1, AA482526.1, AA832468.1, AA417893.1, AI867049.1, D11610.1, AA256313.1, AA034164.1, N27375.1, AW119101.1, AA917795.1, N48340.1, H10359.1, AI290297.1, M240601.1, N23618.1, AA514495.1, AA789034.1, H08100.1, AI061272.1, AA443213.1, R40145.1, D12463.1, AI240093.1, AA493130.1, AA122021.1, AW514004.1, AA994372.1, AA227683.1, AI523990.1, R84780.1, AI634524.1, H06663.1, X91713.1, AA062803.1, AA585119.1, AI283724.1, W19574.1, AA890144.1, AA056271.1, AI644019.1, AW556280.1, AW142557.1, AC013322.5, AL355365.2, AL354880.3, AP000621.1, AC020978.3, AP000725.1, AC012022.5, AC068296.4, AC007481.2, AC015473.3, AC019993.1, AC020978.3, AC001884.6,1, AL157955.1, AC067723.2, AC025164.7, AC021193.3, AC008847.3, AC011672.3, AC024615.1, AC001884.6,1, AC016006.1, AL355587.3, AL139330.5, AP001965.1, AP001870.1, AC068765.2, AC064877.1, AC026233.2, AC022087.3, AC022796.3, AC019111.3, AC018853.3, AC023261.2, AC011577.3, AL049184.5,
SEQ ID NO. 339
NGO-St-147
YS012/T3 5'

AC008122.15, AJ001006.1, AK001469.1, AL139317.2, AC005048.2, AB019225.1, AC006577.2, AL133475.14, AC004665.2, AE003608.1, AE003528.1, AE003502.1, AE003481.1, AE003040.1, AC004541.1, AC002433.1, AC006370.2, AC005820.1, AC007970.3, AF106702.1, AC005209.1, AI251411.1, AJ251407.1, AJ251405.1, Z81077.1, AL110505.3, U00484.1, AB006700.1, X55902.1, X99260.1, U10402.1, M33496.1, AI470259.1, AA269728.1, AA165912.1, AA574026.1, AW823761.1, C88768.1, AU040593.1, AA437608.1, AU043208.1, AA138266.1, AW123976.1, AI117993.1, AA413583.1, AA511047.1, AV040202.2, AI632462.1, AV068478.1, AV051231.1, AV113738.1, AA570941.1, AA516855.1, AW636925.1, AA591652.1, AV051161.1, AL043808.1, AL043785.1, T52030.1, AV140546.1, AV254998.1, AW159747.1, AV003504.1, AW874810.1, AW874808.1, AW350719.1, AW349722.1, AW266183.1, AW265812.1, AV383092.1, AW053464.1, AI946267.1, AV126934.1, AV054231.1, AI513554.1, AI308193.1, AI307218.1, AI302479.1, AA933435.1, AA749496.1, AA681005.1, AA484958.1, AC027238.2, AC011626.2, AC009901.3, AC011050.4, AC067959.3, AC012591.4, AC010872.4, AC067717.5, AC025613.9, AC068958.1, AC048371.2, AC020933.4, AC020919.4, AC012619.5, AC008110.2, AC009658.5, AC025916.2, AC044804.1, AC011851.3, ALL21986.3, AL132875.10, AL139136.3, AL159162.3, ALL21994.4, AC063926.3, AC037443.2, AC069046.1, AC061958.4, AC011400.4, AC009552.4, AC008157.2, AC061969.1, AC016005.4, AC021150.5, AC026045.3, AC032043.1, AC026225.2, AC023789.5, AC011259.3, AC022535.2, AC026403.1, AC009206.19, AC021236.3, AC022646.3, AC016130.13, AC013624.4, AC010920.10, AC010846.11, AC010575.3, AC010714.3, AC016020.4, AC022892.1, AC014418.1, AC014941.1, AC015401.1, AC020227.1, AC010039.3, AC009409.1,

TABLE 1-continued

Sequence homologies (GenBank Accession Numbers)

AC008233.2, AC005861.2, AL035662.50, AL356157.3, AL356243.1, AL133383.6, AL356074.1, AL160057.4, AL138745.2, AL158049.2, AL139044.2,
SEQ ID NO. 340
NGO-St-147
YS012/T7 3'

AL139317.2, AK001469.1, AC008122.15, AJ001006.1, AC009410.3, L12018.1, U83433.1, Z74022.1, AL034412.1, AB001489.1, AB022219.1, M84800.1, AF147847.1, AF147846.1, AF147845.1, AF147844.1, AF147843.1, AF147842.1, AF147841.1, AF147840.1, AF147839.1, AF147838.1, AF147837.1, AF063009.1, U76307.1, AC005271.1, U89959.1, AJ252011.1, AL139078.2, U53151.1, Z95325.2, S41204.1, AL049558.1, Y09076.1, AE003714.1, AC004159.1, AC008282.2, AF116775.1, AC004473.1, AL049834.3, AP001341.1, AB022220.1, AW673739.1, AI924794.1, AA505423.1, AA547973.1, AW476696.1, AI375468.1, AA490741.1, AI650930.1, N33900.1, T80743.1, AW390137.1, AW123976.1, AV161628.1, AV054231.1, AV278595.1, AV084476.1, AW744691.1, AW744450.1, AW533639.1, AV282413.1, AV044333.2, AI551443.1, AA894037.1, AU015537.1, AI060677.1, AA914429.1, AA124598.1, AA106135.1, AA091966.1, AW612625.1, AW590439.1, AW580242.1, AW470767.1, AW419111.1, AW414987.1, AW235931.1, AV264281.1, AV262910.1, AW010145.1, AW003523.1, AI969923.1, AI932268.1, AI913209.1, AI767599.1, AI683830.1, AI674202.1, AI662375.1, AI631854.1, AI623462.1, AI611342.1, AI607109.1, AI431890.1, AA999142.1, AI420398.1, AI378212.1, AI374843.1, AU001077.1, AI229770.1, AI170057.1, AI167540.1, AI092928.1, AI086083.1, AA854387.1, AA846367.1, AA830290.1, AA829162.1, AA825305.1, AA805644.1, AA764831.1, AA620645.1, AA481088.1, AA458626.1, AA450287.1, AA291148.1, AA281054.1, AA226512.1, AA226197.1, AA168415.1, AA165253.1, R42183.1, AC027238.2, AC011626.2, AC009901.3, AC040166.2, AC009040.4, AC023922.2, AC034280.2, AC016836.3, AC009967.3, AP001767.1, AP000873.1, AC025572.7, AC021850.4, AC021433.3, AC006914.1,
SEQ ID NO. 341
NGO-St-148 combined AL137480.1, AB023231.1, U40750.2, AL161537.2, AL035528.2, AC010163.7, AC010349.7, AF039218.1, Z81543.1, M94288.1, M94287.1, NM_016445.1, AC006836.6, AC024818.1, AC024807.1, NM_0137381 AF228603.1, AP170564.1, AC009248.6, AF157600.1, AL079303.3, AL109943.18, AL132767.7, Z82060.1, AL049557.19, X13299.1, AB004907.1, L24799.1, AC006830.1, U50068.2, AC005158.2, AF022981.2, AC003667.1, Z78067.1, AL031321.1, Z96050.1, Z46833.1, AB006697.1, X73124.1, AW117284.1, AA262295.1, AW360988.1, AW802874.1, AA069718.1, AI083506.1, AI334961.1, AA828106.1, AI804127.1, AI356296.1, AI350150.1, AA332524.1, AA069718.1, AW802869.1, N49573.1, AW589778.1, AI867753.1, AI760381.1, AW802871.1, AW456665.1, AW455922.1, AA262179.1, AW491676.1, AW296806.1, AA313126.1, AA317431.1, AA175408.1, AV353681.1, AI050623.1, AW372307.1, AV247054.1, AW601336.1, AV353772.1, AW739466.1, AW463082.1, AA069694.1, N46881.1, AI583051.1, Z21094.1, AW372290.1, R93780.1, AI885774.1, AI564960.1, AI078757.1, AA189821.1, AW007570.1, AV370618.1, AW145277.1, AI607201.1, AA963498.1, AA645938.1, AW856031.1, AW545487.1, AW539636.1, AW271206.1, AW159052.1, AW139577.1, AI659421.1, AI605334.1, AI593613.1, AI394313.1, AI326844.1, AA823548.1, C50352.1, AA403397.1, AA308562.1, AA304772.1, W01829.1, N73719.1, H80192.1, AW689768.1, AW613941.1, AW593986.1, AW241950.1, AW200551.1, AV310318.1, AI945889.1, AI773675.1, AI7fl665.1, M431451.1, AI356965.1, AI253127.1, AA042714.1, C66989.1, AA040979.1, AA292105.1, AA195534.1, W37558.1, N76774.1, F19972.1, T60368.1, T60336.1, D15992.1, AC021443.5, AC012436.4, AC011689.3, AC021800.3, AC021239.3, AC011841.3, AC024298.2, AC023404.2, AC009163.4, AC015861.5, AC009778.3, AL139012.1,
SEQ ID NO. 342
NGO-St-148
YS147/T3 5'

AL137480.1, AB023231.1, U40750.2, AL161537.2, AL035528.2, AC010163.7, AC010349.7, AC006063.1, AP039218.1, Z81543.1, M94288.1, M94287.1, AC007878.2, AC006836.6, AC024818.1, AC024807.1, AC002451.1, AL079303.3, AL132767.7, Z82060.1, AB004907.1, L247991, NC_001141.1, AC008417.3, AC006830.1, AE003680.1, AE003570.1, AP165175.2, AC004544.1, AF220199.1, AC005536.2, AC009248.6, AF101319.2, U50068.2, AP115510.1, AC005158.2, AF022981.2, AC005731.2, AF108122.1, U52112.1, AC005179.1, AC003667.1, AF047658.1, AL163216.2, AL132641.2, AL161548.2, AL031670.6, AL137228.2, AL132774.20, AC000960.1, Z68128.1, Z81490.1, AL009048.1, AL024497.5, AL021713.1, AL114454.1, AJ010712.1, Z4.6833.1, AP001671.1, AK000884.1, AP001168.1, AB007649.1, AB006697.1, AA262295.1, AW802874.1, AW360988.1, AA332524.1, AA069718.1, AW802869.1, AW589778.1, AI867753.1, AW802871.1, AA317431.1, AW372307.1, AW601336.1, AA069694.1, N46881.1, AW372290.1, AI885774.1, AI564960.1, AW296806.1, AI078757.1, AW117284.1, AA313126.1, AA189821.1, AA175408.1, R93780.1, AW456665.1, AW455922.1, AI334961.1, AI083506.1, AI050623.1, AA971329.1, AW463082.1, AI760381.1, AW007570.1, AA828106.1, AV370618.1, AW145277.1, M607201.1, AA963498.1, AA645938.1, AW545487.1, AW539636.1, AI605334.1, C50352.1, AW689768.1, AW613941.1, AW613928.1, AW593986.1, AW289470.1, AW241950.1, AW200551.1, AV310318.1, AW096858.1, AI945889.1, AV105697.1, AI723665.1, AI431451.1, AI356965.1, AI253127.1, AA547168.1, AA479162.1, AA292105.1, AA195534.1, W38696.1, W37558.1, H63593.1, D15992.1, AC021443.5, AC012436.4, AC024298.2, AL022594.18, AC010181.6, AC069244.1, AC023797.8, AC026419.2, AC011468.4, AC009163.4, AC009105.6, AC009054.4, AC015840.2, AC026948.2, AC011032.3, AC013370.5, AC017069.3, AC021225.3, AC007865.5, AC009676.2, AC006871.1, AC006878.2, AC006803.2, AL133227.11, AL353726.1, AP000767.1,
SEQ ID NO. 343
NGO-St-148
YS147/T7 3'

AL137480.1, AB023231.1, U40750.2, AL031121.5, NM_016445.1, AC010349.7, NM_013738.1, AF228603.1, AP170564.1, AF157600.1, AF047658.1, AL109943.18, AL049557.19, AC008970.4, NC_001141.1, AC004998.2, AC007392.3, AP131217.2, AC007617.10, AP124523.1, AF165147.1, AF146367.1, AF125463.1, AC003027.1, U49398.1, AC004582.1, AC005222.1, AF067618.1, AL110292.4, AL163247.2, AF016681.1, AL133454.3, Z92839.1, AL096854.5, Z78067.1, Z98755.1, AL031321.1, AL008709.1, AL022154.1, AL020990.1, Z96050.1, Z46833.1, Z99123.1, X73124.1, AW117284.1, AA971329.1, AI083506.1, AI334961.1, AA828106.1, AI804127.1, AI356296.1, AI350150.1, AW360988.1, N49573.1, AI760381.1, AW456665.1, AW455922.1, AA262179.1, AW491676.1, AW296806.1, AA313126.1,

TABLE 1-continued

Sequence homologies (GenBank Accession Numbers)

AA175408.1, AV353681.1, AI050623.1, AV247054.1, AV353772.1, AA739466.1, AW463082.1, AV331020.1,
AI583051.1, Z21094.1, AA262295.1, R93780.1, AI885774.1, AI742950.1, AW856031.1, AW271206.1, AW159052.1,
AW139577.1, AI659421.1, AI593613.1, AI394313.1, AI326844.1, AI291896.1, AA823548.1, AA750605.1, AA660959.1,
AA403397.1, AA308562.1, AA304772.1, W01829.1, N73719.1, H80192.1, AW453398.1, AV370618.1, AI773675.1,
AV024594.1, AA701705.1, AA656478.1, c66989.1, N76774.1, T6036&1, T60336.1, AC021443.5, AC012436.4,
AC011689.3, AC011841.3, AC023598.10, AC026071.2, AC035146.2, AC008784.5, AC021689.2, AC026070.2,
AC023404.2, AC024116.10, AC027308.2, AC067914.1, AC044895.1, AC016039.3, AC025081.2, AC015861.5,
AC016010.1, AC006843.1, AL356264.2, AL160264.3, AL138903.3, AL353655.2, AL139012.1, AP001834.1, AP000612.1,
SEQ ID NO: 344
NGO-St-149
YSI84/T3 5' Sequence 797 bp AC006151.3, AE003519.1, AC019018.7, AC005588.1, AF104455.1, X98659.1, AP001278.1, AE003527.1, AC005065.1,
AF147262.1, AL163239.2, AL161579.2, AL161578.2, AL161505.2, AL021633.2, Z54307.1, AL080283.1, X53495.1,
AP001694.1, AP000139.1, AP000226.1, AP000087.1, X81824.1, AC002510.2, AC006717.1, AF224669.1, AC005844.7,
AF126483.1, AF097025.1, AL163241.2, AL109827.8, AL109920.15, AL132879.2, AL132952.1, AL021707.2, U80439.1,
AL031075.1, AL031119.1, AB030316.1, AP001696.1, AP001421.1, AB016236.1, AK001470.1, AK001265.1, AJ010952.1,
AP000154.1, AP000013.2, AA463576.1, N56580.1, AI510521.1, AA164557.1, AA123334.1, AL079845.2, AW296098.1,
AI509555.1, AA856443.1, T06332.1, AI122290.1, AI548925.1, AW299478.1, AW075969.1, H60790.1, AI248071.1,
AA693818.1, AA703057.1, H66947.1, I79937.1, R93072.1, AW365959.1, AA183383.1, AA184145.1, N55957.1,
AV295673.1, R91524.1, AA272832.1, N53457.1, AW189470.1, AW189153.1, AI657682.1, AI457040.1, M456849.1,
AI187906.1, AA440449.1, AA390650.1, H57909.1, AW755551.1, AW673175.1, AW634103.1, AW512222.1,
AW472370.1, AW167354.1, AW055228.1, AW043984.1, AI856773.1, AI856421.1, AI831310.1, AI805882.1, AI609204.1,
AI507816.1, AI492820.1, AI498201.1, AI471710.1, AI459185.1, AI449761.1, AI092297.1, AI066451.1, AI041708.1,
AA902946.1, AA885085.1, AA868367.1, AA843991.1, AA832096.1, AA739657.1, AA707993.1, AA551869.1,
AA503125.1, AA476245.1, AA291657.1, AA291215.1, AA137908.1, AA063397.1, AA056015.1, W94514.1, W49769.1,
N91044.1, N51028.1, H73729.1, H72793.1, H17320.1, H16511.1, R12496.1, R03444.1, F10023.1, T06260.1, AL139323.2,
AL159974.3, AL139006.3, AC025368.1, AC025027.4, AC026667.2, AC021806.4, AC025226.2, AC011753.2,
AC009380.4, AC010004.3, AC009372.4, AC015159.1, AC011900.1, AC012020.8, AC022296.8, AC011464.4,
AC044876.1, AC027691.1, AC020478.1, AC016111.1, AC020649.4, AC008448.5, AC008575.4, AC008276.2,
AC018797.3, AC019292.4, AC024921.2, AC008050.3, AC020617.2, AF230637.1, AC017114.3, AC009713.2,
AC016907.1, AL355380.1,
SEQ ID NO. 345
NGO-St-149
YS184/T7 3'

AC004952.2, AB002316.1, AC005171.2, AE003697.1, AC005233.2, AC008078.11, U73509.1, AC004600.2, AC004259.1,
AC008498.3, AC007171.4, AC024864.1, AC024206.1, AC009248.6, AF133300.1, AC007157.6, AL353814.1, Z81081.1,
AI041842.1, AA535122.1, AA858272.1, AW173550.1, AI075241.1, AI949683.1, AI459566.1, AW662874.1,
AW016852.1, AI393789.1, W38376.1, AI660675.1, AW374022.1, AI092706.1, AA614653.1, N22273.1, AI374912.1,
N81171.1, AI307141.1, AW316689.1, AA702628.1, N50149.1, AA665756.1, AA908261.1, AA906275.1, AA122792.1,
AI228214.1, R81288.1, AA789088.1, AI149042.1, AW544305.1, AA016222.1, AA781542.1, AA907460.1, AI787663.1,
H95911.1, AI747696.1, M408499.1, H69908.1, AA185425.1, AA493271.1, D82413.1, AI449623.1, AW020583.1,
AA399746.1, AA165348.1, AI549947.1, AA458167.1, AA690581.1, C86225.1, C85754.1, AV296844.1, AA476396.1,
AI394925.1, AI227433.1, AA901298.1, AV314025.1, AV366383.1, AV304720.1, AV298962.1, A3395178.1,
AW803080.1, AV295103.1, AV304045.1, AV295412.1, AW365959.1, AI457967.1, AW471971.1, AI392175.1,
AW805830.1, M922173.1, AW010332.1, AA620178.1, AI974964.1, AW863569.1, AW285356.1, AW017227.1,
AI976687.1, AI976615.1, AI975238.1, AV159280.1, AI803639.1, AV089896.1, AI471454.1, C99130.1, AA508293.1,
AA508283.1, AA508275.1, AA233975.1, AA185761.1, AA185758.1, AA185813.1, AA185829.1, AA133583.1, Z45321.1,
AL159974.3, AC025368.1, AC017000.2, AC024737.5, AC063941.4, AC063926.3, AC025837.2, AC023555.3,
AC021587.1, AL356320.1, AL355606.2, AC068498.1, AC027320.2, AC026425.2, AC016099.3, AC022608.2,
AC021603.2, AC006095.1, AL355532.4,
SEQ ID NO. 346
NGO-St-150
YS255/T3 5'

AL137786.2, AE001106.1, AL109657.8, AE003536.1, AL032649.1, AC000095.3, AC010283.5, AC007370.7, U02206.1,
U39718.1, AC005319.1, AL163237.2, U59177.1, U59176.1, AL031729.16, Z70754.1, Z98885.1, L41917.1, L41886.1,
X05181.1, X04572.1, AP001692.1, AP000147.1, AP000233.1, Z99105.1, Z99104.1, D14465.1, AB006424.1, D81907.1,
AA186486.1, AI752319.1, AW515316.1, AI633878.1, AA724174.1, N98699.1, AW088411.1, AI818209.1, AA360504.1,
AW207435.1, R77568.1, D78858.1, AW083012.1, AI927938.1, AI669659.1, AA902264.1, AWl05148.1, H83314.1,
AA300827.1, AW410334.1, AA431514.1, AI420205.1, AI752320.1, AI283114.1, D78824.1, AI743602.1, AI417561.1,
W00707.1, N66098.1, N90043.1, AA573278.1, AA043792.1, AC00128.1, AW796219.1, AI819645.1, AA329088.1,
AW796258.1, AA043666.1, AI434568.1, AA973972.1, AI631297.1, M638738.1, AI440413.1, AI048750.1, AI702887.1,
AA431188.1, AA653570.1, AA348799.1, AI749472.1, AA210446.1, AW275782.1, AW275777.1, AA105091.1,
AA137746.1, AA704575.1, AA561636.1, AA096434.1, AI753861.1, AJ396210.1, AI394687.1, AI962149.1, AA809488.1,
AI440138.1, AL135399.1, AI058992.1, D62361.1, AW089455.1, AW322669.1, AA114807.1, AI925346.1, AA120374.1,
AA153007.1, AW342822.1, AI982313.1, AA174177.1, AI981814.1, AU017382.1, AA561870.1, AW363585.1,
AI576378.1, AW734057.1, AW333950.1, AW332559.1, AW2.57529.1, W31991.1, AC027672.3, AC013243.4,
AL133461.2, AC023317.2, AL161659.10, AC010031.5, AC013267.2, AC017582.1, AL008876.1, AC016927.5,
AC024903.5, AC068921.2, AC009463.6, AC008368.18, AC010448.4, AC009162.5, AC010727.3, AC021484.3,
AC017044.2, AC022372.3, AC010901.3, AC019010.1, AC009624.2, AL353145.2, AL161451.4, AL138878.3,
AL133543.2, AL031744.7,

TABLE 1-continued

Sequence homologies (GenBank Accession Numbers)

SEQ ID NO. 347
NGO-St-150
YS255/T7 3'

AE003626.1, AC005890.1, AL034556.3, AL008971.1, AC008873.4, AE003736.1, AE003708.1, AC005242.1,
AF034902.1, AL163225.2, AL132796.2, AL031905.7, AL035530.11, AJ131836.1, AL035532.1, AC008865.3,
AC007047.6, AE003545.1, AE002786.1, AC004547.1, AC005251.1, AC012680.3, AC005489.1, AF121782.1,
AC006421.1, AE001428.1, AE001413.1, AF078780.1, AF064857.1, AL163281.2, AL133299.2, Z99773.1, AL096770.14,
U39847.1, Z99281.1, Z68215.1, Z97055.1, Z97209.1, U32078.1, U50071.1, Z31356.1, U21731.1, AJ235270.1,
AB015469.1, Y11842.1, X94355.1, AW771521.1, AA126445.1, AW514659.1, AW182807.1, AW771502.1, AA938728.1,
AI090291.1, AI493810.1, AW675411.1, AA427532.1, AA349431.1, N62707.1, AW512566.1, AA058340.1, AA345941.1,
AA588743.1, AW189042.1, AA187281.1, AW089555.1, AI678159.1, AI366801.1, AA829470.1, C02522.1, AI332895.1,
T40865.1, AA970774.1, D79887.1, AA456027.1, AW149169.1, AI220712.1, AA310489.1, T40872.1, M932606.1,
AI587187.1, AA054496.1, D61745.1, AA126569.1, AA455387.1, AA292619.1, AA767314.1, T39804.1, T39783.1,
AA766576.1, AA292620.1, AW315966.1, AW312359.1, AI551720.1, AA445754.1, AI157081.1, AA879725.1,
AW347573.1, AI527455.1, H64492.1, AI341051.1, AI082974.1, AW863369.1, AW637708.1, AW618562.1, AW618323.1,
AW610946.1, AW533222.1, AW528171.1, AW514564.1, AW399714.1, AW399655.1, AW349594.1, AW293159.1,
AW276976.1, AI843747.1, AI663436.1, AI392688.1, M288400.1, AA805183.1, AA561027.1, AA537476.1, AA455793.1,
AA447110.1, AA434507.1, AA282194.1, AA101103.1, R81554.1, AC013243.4, AL133461.2, AC027672.3, AC018864.4,
AF215845.1, AC069162.1, AL355312.3, AC020324.1, AC007291.23, AL356254.1, AC011970.1, AC009613.2,
AL163537.4, AL157957.1, AC068957.1, AC067779.1, AC011562.4, AC019950.1, AL121928.10, AL157396.3,
SEQ ID NO. 348
NGO-St-151
YS1652/T3 5'

AC003682.1, X15544.1, X16618.1, AK000267.1, M29411.1, NM_007673.1, AF104031.1, Z81009.1, S74520.1, U00454.1,
AC011749.2, AE003587.1, NM_005231.1, NM_006030.1, AC004793.2, U34879.1, AF040709.1, U37521.1, AF054997.1,
AF042793.1, AF042792.1, AI251368.1, AJ251367.1, Z84492.2, AJ251914.1, AL121757.7, Z92845.1, L21886.1,
AB040919.1, Z35691.1, M98343.1, AB011130.1, AA160768.1, AA454976.1, AA524918.1, AA160767.1, AW177242.1,
AA524934.1, AW603587.1, AI909371.1, AW754009.1, AW604563.1, AW843725.1, AA236418.1, AA327082.1,
T64077.1, AI981337.1, AI795303.1, AI639685.1, W78194.1, AW761561.1, AW326881.1, AW326538.1, AI327188.1,
AI323297.1, AI273360.1, AI272717.1, AA876719.1, AA016882.1, W63915.1, N39838.1, AW699234.1, AW677045.1,
AW658137.1, AW578415.1, AW392015.1, AW370009.1, AL134942.1, AW034847.1, AI527711.1, AA543942.1,
AA378725.1, AA315097.1, W14378.1, W07354.1, U18015.1, T49796.1, AC068266.1, AC011089.4, AC006330.3,
AC061995.1, AC0241.15.7, AC021247.4, AC027349.1, AC022585.1, AC011166.2, AL133331.12, AL158834.4,
AL353680.3, AL158065.3, AP001374.1, AP001339.1, AC010299.4, AC009143.4, AC009123.5, AC009041.5,
AC017067.3, AC010131.2, AC025353.2, AC046157.1, AC02.3825.3, AC026070.2, AC035886.1, AC035885.1,
AC028189.1, AC019231.3, AC022608.2, AC016716.2, AC011035.3, AC017033.2, AC024117.1, AC012004.3,
AC021764.1, AC015049.1, AC008228.2, AL356241.2, AL355483.2, AL356116.1, AL356007.1, AP001554.1,
SEQ ID NO. 349
NGO-St-152
YS1704/T3 5'

AB033096.1, AF031242.1, M84990.1, L06863.1, U82671.2, AC003991.1, AF134576.1, AF070552.1, AC004040.1,
U82696.1, AC001231.1, AL135745.2, AL121774.3, AC001477.1, AL133220.1, Z69655.1, Z33874.1, AW847517.1,
AW762077.1, AW437401.1, AW463000.1, AI005887.1, AA133529.1, AI959464.1, AI650192.1, AA578951.1, R15953.1,
M75813.1, AC026573.3, AL353588.2, AL353672.2, AC010195.7, AC009520.7, AC010274.3, AC010464.4, AC046150.2,
AC025353.2, AC010864.2, AL139090.3, AL022344.1, AC011966.3, AC024727.4, AC009362.5, AC009180.7,
AC011967.3, AC009621.4, AC007846.2, AC023959.2, AC023850.2, AC007608.2, AC007728.1, AC021596.1,
AL136171.6, AL162741.3, AL162731.2, AL161933.3, AL139405.2, AP001591.1,
SEQ ID NO. 350
NGO-St-152
YS1704/T7 3'

AB033096.1, AC004812.1, AL133249.1, AC000052.16, AC004019.20, U62317.2, AL163285.2, AC002091.1,
AL050307.13, AC000134.14, AC007051.3, AL031289.1, AC005412.5, AC006273.1, AL034350.2,
AL033392.5, AC005755.1, AF001549.1, AL160237.2, AL110502.1, AF053356.1, AC010328.4, AC008518.3,
AC007917.15, AC007066.4, AL117352.12, U75285.1, Z83823.1, AC000159.6, AC020663.1, AC005288.1, AC004821.2,
AC005324.1, AL121601.13, AL035411.27, AP000555.1, AC006344.2, AC006480.3, AC005856.1, AC005215.1,
AC004057.1, AC008079.23, AC016025.12, AC008101.15, AC006138.1, AL023882.2, AL031224.1, Z95152.1,
AF064862.1, AC004087.1, AC005231.2, AL096700.14, AC009516.19, AC005747.1, Z97630.11, AC005500.2,
AC004982.1, AF037338.1, AC005785.1, AL133353.6, AL121964.16, AL096712.20, AP000188.1, AP000044.1,
AP000112.1, AC007312.1, AC007097.4, AC005486.2, AC005013.1, AC008168.3, AC01017O.3, AC005037.2,
AP000193.1, AC007956.5, AC007055.3, AC006207.5, AC004210.1, AL049780.2, AC008925.3, AC006046.1,
AP000191.1, AP000115.1, AC007655.1, AC005089.2, AC005740.1, AL033525.10, AC005018.2, AL022727.1,
AP001412.1, AP000152.1, AC006582.13, AC000081.2, AC003006.1, AC007057.3, AP000692.1, AC007565.1,
AP001331.1, AC011465.4, AC007766.1, W79504.1, AF150152.1, AI246796.1, AW303196.1, AW274349.1, AA441788.1,
N54902.1, AI284640.1, AW872676.1, AW473467.1, AW301350.1, AC005423.1, AL135724.1, AL684097.1, AI041706.1,
AW473163.1, AW168342.1, AW022379.1, AI633168.1, AI334435.1, T41242.1, AW338508.1, AI471481.1, AA381147.1,
AL079645.1, AI732186.1, F36273.1, AI635818.1, AI569086.1, AI281881.1, AI160117.1, AI079910.1, AA598586.1,
AA502155.1, AA491814.1, AA147750.1, AW057877.1, AI873916.1, AI537955.1, AA649642.1, AA487277.1,
AW301809.1, AI439210.1, AA604607.1, AA179944.1, AW873290.1, M499181.1, AI446464.1, AI432270.1, AI064864.1,
AI061313.1, AA713891.1, AA482681.1, AL042856.3, AW088049.1, AA580808.1, AI561255.1, AA207129.1,
AA171473.1, AA223206.1, AI085719.1, AA448858.1, AW615709.1, AW576503.1, AL138396.1, AI921061.1,
AI754336.1, AI358812.1, AI079389.1, AI076766.1, AA634196.1, AA071393.1, C06339.1, AW081941.1, AW304805.1,
AW152057.1, AW020992.1, AI920876.1, AI654247.1, AI571562.1, AI567712.1, AI358813.1, AI351698.1, AI289447.1,
AI087133.1, AA533060.1, AI125107.1, AA765170.1, AA634272.1, AA633582.1, AA598425.1, AA551409.1,

TABLE 1-continued

Sequence homologies (GenBank Accession Numbers)

AA485930.1, AA151690.1, AA115165.1, AA082854.1, AA053128.1, W49595.1, N64547.1, AA443390.1, AL353672.2,
AC026573.3, AL353588.2, AC009444.2, AC004795.2, AL137222.3, AC026413.2, AC017099.3, AC024088.3,
AC008610.4, AC011442.3, AC011938.3, AC021455.3, AC018821.3, AC025287.2, AC020954.5, AC024438.2,
AC013371.4, AC051660.3, AC019280.3, AL353729.2, AC017057.5, AC025341.2, AL136300.9, AL158830.5,
AC023156.3, AC010607.4, AC034121.2, AC010130.4, AL117259.2, AC010395.5, AC009191.4, AC026397.2,
AC013805.4, AC022181.3, AC023583.2, AC022460.2, AL161731.4, AL136311.3, AP001528.1, AC007780.2,
AC026587.2, AC017083.4, AC023359.6, AC067749.2, AC026964.2, AC018989.3, AC011845.3, AC026294.1,
AC022911.2, AC055890.2, AC024934.8, AC055791.2, AC025683.2, AL139109.2, AL138901.2, AC017100.3,
AC009268.2, AC018862.3, AC024005.2, AC011092.1, AC025559.2, AC011443.4, AC007491.3, AC025145.2,
AC027497.2, ALL21971.2, AP001076.1, Y 12335.1, AC026546.2, AC034181.1, AC022286.4, AC021024.2, AC021933.1,
AC010455.3, AC024990.2, AC019206.3, AC021671.1, AL354986.1, AC022169.2, AC022966.2, AL355348.3,
AF228728.1, AC025354.2, AC015726.3, AP001098.2, AC026050.3, AC025963.2, AC012128.3, AL160393.6,
AC063960.2, AC022261.3, AC019291.4, AL356292.1, AC040922.2, AC012411.3, AC027546.1, AL353749.1,
AC055767.1, AC011638.3,
SEQ ID NO. 351
NGO-St-153
YS1754/T3 5'

AC004498.1, AC007956.5, AE003532.1, AF050157.1, Z37979.1, AC003028.2, AE003794.1, AE003615.1, AC006530.4,
AC007977.11, AC006120.1, AE000679.1, AL133073.1, Z69662.1, U11039.1, Z99113.1, Z99112.1, AI005288.1,
AI750442.1, R44564.1, F01704.1, AW614231.1, AW058657.1, AI808100.1, AI743405.1, AI726212.1, AI692280.1,
AI675621.1, AI343951.1, AI342528.1, AA400627.1, AA400382.1, H00353.1, R56558.1, AW530608.1, AW530607.1,
AI941583.1, AV185720.1, AI229512.1, C42486.1, C42424.1, AA470046.1, AA446177.1, AA398518.1, AA393260.1,
AA090525.1, D75049.1, AL138764.3, AL355355.1, AC008528.5, AC011350.4, AC008591.4, AC011325.8, AC013337.5,
AC024018.1, AL118511.22, AC024400.2, AC025205.2, AC022816.9, AC022059.2, AC019274.3, AC013814.3,
AC023206.2, AC012359.3, AF215849.1, AC019852.1, AP001564.1, AC068133.2, AC026029.3, AC023332.3,
AC064814.3, AC009452.9, AC068727.1, AC010398.6, AC009440.2, AC013570.3, AC011116.3, AC019264.3,
AC018606.3, AC025827.2, AC011278.4, AC020571.2, AC010858.3, AC022955.3, AC022937.3, AC007838.10,
AC024032.2, AC012287.2, AC020967.1, AC019998.1, AC012229.2, AC018325.1, AC008345.2, AL158837.4,
AL160235.1,
SEQ ID NO. 352
NGO-St-153
YS1754/T7 3'

AF119869.1, AC011297.3, AL031599.1, AC016951.9, AC007129.3, ACZ0054L2.5, AC006409.2, AF027153.1,
AL163264.2, AL121761.5, AL121756.14, AL023096.1, AP001719.1, AP000467.1, AP000496.1, AP000118.1,
AB020874.1, AC000036.5, U91318.1, U95740.1, AC004409.1, AL132715.2, Z92844.1, AP000074.1, AC002038.1,
AC000361.1, U91326.1, AC002544.1, AC005619.1, AL050325.20, Z84466.1, U01337.1, L24038.1, AC005781.1,
AF001552.1, U91321.1, AC004962.1, AC003969.1, AC005224.1, AC004499.1, AC002549.1, AL080286.16, AL050312.8,
Z82194.1, AL035459.6, AL031657.2, M21488.1, AP000545.1, AP000544.1, AC000105.41, AC005191.1, AC004874.1,
AC007358.2, AC006961.16, AC006552.7, AC004032.7, AC004126.1, AC004501.1, AL163259.2, AL078582.13,
AL035683.9, AL117694.3, AL035665.29, AC002070.1, AL023513.1, AL035693.19, AL049749.2, Z73420.1, Z95116.1,
Z82196.2, AI049709.15, Z92545.1, AL022577.1, AL034424.9, Z93016.1, AP001714.1, L35930.1, Z83733.1,
AC011595.12, AC005165.1, AC007649.12, AC006230.11, AC002375.1, AL096814.26, Z83851.17, AL031651.33,
AL035684.25, AL031054.1, AL031984.13, AC005895.1, M99412.1 AC004147.1, AL031674.1, U95743.1, AC006965.3,
AL023804.1, AL031256.1, Z83732.1, AA583783.1, AA352852.1, AI750443.1, T97047.1, AI206381.1, AW779140.1,
AW392720.1, AW392037.1, AW375505.1, AW375664.1, AI917309.1, AI245002.1, AA972389.1, AA348114.1, H83083.1,
AI677865.1, AW081092.1, R68753.1, R36634.1, R36114.1, T39347.1, AL134762.1, AI950057.1, AI948415.1,
AI913632.1, AL043389.1, AI760277.1, AI636038.1, AI422711.1, M174489.1, AI097075.1, R92107.1, R36101.1,
AW205700.1, AI857496.1, AI241546.1, AI052617.1, AA862242.1, AA682503.1, AA283058.1, AA010393.1, W87478.1,
R98769.1, AW769350.1, AW631324.1, AW606680.1, AW380595.1, AW358828.1, AW170684.1, AI968735.1,
AI916948.1, AI823617.1, AI798803.1, AI793154.1, AI692607.1, AI654898.1, AI208889.1, AI076838.1, AA770067.1,
AA631910.1, AA613927.1, AA548931.1, AA426207.1, AA180428.1, AA128302.1, H54911.1, H16066.1, H14830.1,
R46689.1, R09295.1, R09229.1, T91813.1, F12420.1, I74282.1, T66898.1, AW406178.1, AW113986.1, AI741532.1,
AI674059.1, AA883361.1, AA754905.1, AA635120.1, W22245.1, N53160.1, H79438.1, H78261.1, Z41544.1,
AL138764.3, AC017088.3, AC025558.3, AC016313.5, AL139785.1, AC018943.4, AC011652.4, AC022188.3,
AC011247.3, AL109615.18, AL355388.2, AL139019.2, AL158169.1, AC068877.1, AC011388.4, AC008472.4,
AC009823.3, AC016823.4, AC020766.3, AC007602.3, AC025589.6, AC025226.2, AC016399.5, AC009031.2,
AC010755.1, AC007499.1, AL136368.5, AL133478.2, AL138779.3, AP001337.1, AC022844.3, AC068570.1,
AC023403.2, AC022494.3, AC012666.2, AC010866.1, AL354873.3, AC009128.5, AC027486.2, AC046169.1,
AC012222.3, AC018499.2, AL162293.7, AL136131.7, AP000868.1, AP000481.2, AC069233.1, AC069079.1,
AC016530.3, AC015977.3, AL121889.7, AL138766.2, AC036218.2, AC007569.8, AC022362.5, AC064817.3,
AC008714.2, AC008485.3, AC008484.3, AC008977.3, AC027064.2, AC011687.3, AC027580.1, AC011846.5,
AC027143.1, AC024910.2, AC027081.1, AC026403.1, AC022684.2, AC027607.2, AC022818.1,
AC022259.1, AL121987.2, AL355875.2, AL161745.5, AL136086.2, AL162387.3, AL157942.2, Z97197.3, AP001838.1,
AP000777.1, AC067823.2, AC068710.1, AC008623.1, AC023390.2, AC023825.3, AC021990.3, AC023487.3,
AL355300.2, AL161795.2, AC007339.3, AC023091.2, AC022724.1, AL355865.1, AP000848.1, AC026906.2,
AC025868.2, AC036238.1
SEQ ID NO.: 353
Kinesin NM_005552.1, L04733.1, M75148.1, M75147.1, M75146.1, X69658.1 NM_008450.1, AF055665.1, Y14586.1, U48359.1,
AE003540.1, AF055298.1, L11328.1, L110131 NM_008451.1, AF055666.1, L47236.1, 583098.1, Z86099.2,
AC007244.2, NM_004812.1, AC005027.2, AF052577.1, AC005369.1, L47235.1, AC002366.1, U37100.1, AL353815.1,
AL022238.1, U41356.1, U18937.1, D90155.1, D88672.1, AE003569.1, AE003505.1 NM_012656.1, NM_007764.1,
NM_001323.1, AF108766.1, AF145609.1, AF125259.1, AF116268.1, AF093569.1, AF077403.1, AC003973.1, U81233.1,
U40232.1, AJ243516.1, AL135978.2, AJ251761.1, AL161517.2, 573375.1, AJ245739.1, U62800.1, AL049754.1,

TABLE 1-continued

Sequence homologies (GenBank Accession Numbers)

AL049524.1, X14820.1, X84047.1, Y09072.1, Y13714.1, X75972.1, X90648.1, Y14406.1, X76785.1, XS2606.1,
AP000606.1, AB018494.1, AB026650.1, M34270.1, AJ001448.1, D56386.1, AI124665.1, AI879287.1, AW249376.1,
AU076730.1, AL137941.1, AA326459.1, AU080282.1, AU079963.1, M85516.1, AL134331.1, AI576961.1, AU080666.1,
AI840068.1, AU067555.1, AI579813.1, AU067583.1, AA853868.1, AA230534.1, AW068178.1, AI715455.1, AI576664.1,
AI839935.1, AI10740.1, AU079968.1, AI844836.1, AI835061.1, AI849047.1, AI838234.1, AA323263.1, AA509865.1,
AW533285.1, AA647015.1, AA015415.1, AI847415.1, AU067068.1, AI576960.1, AU035615.1, AI073056.1, AA611446.1,
AI839802.1, AI7044.44.1, AA518630.1, AI834986.1, AU035489.1, AU079966.1, AU035489.1, AI837501.1, AW213300.1,
AA410206.1, AI837150.1, AA074408.1, W11435.1, N99532.1, AA615751.1, AU066979.1, AW533735.1, AL043408.1,
AI838411.1, AI837539.1, AU035788.1, W40723.1, AU051216.1, M837589.1, AI643860.1, AI117342.1, AW529922.1,
F06922.1, AU035505.1, AI787782.1, AU078909.1, AI834799.1, AA839731.1, AA794060.1, AA920796.1, AW525818.1,
AI602475.1, AI579543.1, AI579510.1, AI579008.1, AA964280.1, AA818427.1, AI101378.1, AW012089.1, AA943900.1,
AW653245.1, AW522687.1, AA997897.1, AI112976.1, AI641838.1, AA219531.1, AA637666.1, AA007747.1,
AW184674.1, AI959425.1, AI199976.1, AA403503.1, AU066670.1, AI554005.1, AA871286.1, AL139300.2, AC023803.3,
AL355385.2, AL136304.2, AP001812.1, AP001107.2, AP000630.1, AC017329.1, AP000759.2, AC012160.5, AL132666.3,
AC006448.10, AC055757.3, AC068941.1, AC068920.1, AC009276.7, AC019217.4, AC025828.1, AC021436.3,
AC025369.1, AC023304.1, AC021226.1, AC021526.1, AC016103.1, I182207.1, AL158822.4, AL354761.1
SEQ ID NO: 354
ZH068/T3

NM_005552.1, L04733.1, X69658.1, M75148.1, M75147.1, M75146.1, U48359.1, NM_008450.1, AF055665.1, S83098.1,
Z86099.2, AE003547.1, AC019014.1, AL353815.1, AL022238.1, I141356.1, D90155.1, AE0037751 NM_007764.1,
NM_001323.1, AF108766.1, AC007655.1, AF077403.1, AC004049.1, U81233.1, U40232.1, AL135978.2, AL161517.2,
573375.1, U62800.1, AL049754.1, AL049524.1, Y09072.1, X90648.1, X52606.1, AP000606.1, AB026650.1, D56386.1,
AW249376.1, AI879287.1, AU076730.1, AA853868.1, AL134331.1, AA410206.1, N99532.1, AA074408.1, AI124665.1,
AU067068.1, AU066979.1, AU035505.1, AW213300.1, AU080282.1, AU079963.1, AU067583.1, AU035788.1,
AU035615.1, AU035489.1, AW529922.1, AU067555.1, AA647015.1, AA230534.1, AA015415.1, W40723.1, AI787782.1,
AU078909.1, AA518630.3, AA615751.1, AA509865.1, AA326459.1, AU080666.1, AU079968.1, AU079966.1,
AI117342.1, AA794060.1, AU051216.1, AA839731.1, AA920796.1, AI840068.1, AI576961.1, AA219531.1, N84649.1,
AI816679.1, AW727794.1, AW730774.1, AI579813.1, N84562.1, AW730835.1, AI816625.1, AI816616.1, AI816604.1,
W11435.1, AW726912.1, AW547881.1, AV387868.1, AW212176.1, AW046482.1, AI885674.1 AI871196.1, AI841137.1
AI804245.1, AI743831.1, AU066670.1, AI447212.1, AI368578.1, AI160826.1, AI160877.1, AI127958.1, AI074600.1,
AA793909.1, AA778147.1, AA733052.1, AA726511.1, AA722826.1, AA475518.1, AA444522.1, AA220560.1,
AA158109.1, W82825.1, W84293.1, AA051553.1, AA051548.1, AA032527.1, AA033314.1, AA028401.1, W72895.1,
W65322.1, W56781.1, AL139300.2, AC023803.3, AC012160.5, AL132666.3, AC068941.1, AC068920.1, AC019217.4,
AC025828.1, AC025369.1, AC010058.5, AC023304.1, AC021226.1, AC021526.1, AC020284.1, AC016103.1, U82207.1,
AC006097.1, AL158822.4, AL354761.1, AL133482.5, AC012022.5, AC068296.3, AC020982.3, AC010588.6,
AC008622.4, AC008505.4, AC009110.5, AC008687.3, AC027517.2, AC027274.2, AC016881.4, AC026008.2,
AC025983.2, AC010823.3, AC025049.2, AC025539.2, AC019200.2, AC020602.2, AC023174.1, AC012356.3,
AC021612.1, AC013569.3, AC014778.1, AC007821.3, AL355773.1
SEQ ID NO: 355
ZH068/T7

AL133587.1, NM_005552.1, L04733.1, AF037222.1, Y14586.1, M75148.1, M75146.1, M75147.1, NM_008450.1,
AF055665.1, AE003498.1, AL138995.3, AL109758.1, AJ006920.1, M30933.1, AC005817.7, AC007920.18, AC008757.5,
AC008806.4, AE003616.1, AF146041.1, AF146040.1, AF037207.1, AF044311.1, U20824.1, AF032908.1, AL163271.2,
AL163265.2, AC000403.1, AL160371.1, US 9924.1, AL137646.1, AL008733. t0, AJ250724.1, Z98047.1, Z68873.1,
X75837.1, U16720.1, AP001726.1, AP001720.1, L27056.1, D26607.1, D85922.1 X76303.1, X88930.1, AP001081.1,
AP001073.1, AP000697.1, AP000I71.1, AP000056.1, AP000330.1, AP000124.1, L26914.1, 1,23210.1, M95296.1,
L10693.1, M93718.1, M95674.1, M99057.1, M89952.1, Y13909.1, X80330.1, AB011094.1, AI890626.1, AW249492.1,
AI972783.1, AI703377.1, AW340857.1, AI973281.1, AI863270.1, AA768039.1, M925587.1, AA779883.1, AA713665.1,
AI915584.1, AA621710.1, AA748819.1, AW662411.1, AA598434.1, AI696373.1, AI698409.1, AA853867.1, AL043409.1,
T47479.1, T29447.1, AI652911.1, AI634115.1, AW196565.1, AA477672.1, AI702023.1, AI648382.1, AA826914.1,
AI571056.1, N52851.1, AW146276.1, AA217120.1, AW742846.1, AI879667.1, AI097557.1, AW089057.1, AW070687.1,
M377204.1, AA284075.1, AW749735.1, AW138863.1, AI422004.1, H21003.1, AI424093.1, AA899876.1, R35099.1,
AI874768.1, AA476716.1, AW495295.1, AW108197.1, AA212157.1, W81854.1, W62338.1, H33481.1, AA270658.1,
W16197.1, H20962.1, AA683381.1, W46349.1, AA734911.1, W99868.1, AA000386.1, AW802827.1, AW434399.1,
AA167982.1, AA032596.1, H27867.1, AI472226.1, AI702024.1, AW370572.1, AW178030.1, AW178028.1, AW632540.1,
AW177972.1, AV3 56544.1, AV354772.1, AV327680.1, AV287310.1, AV287072.1, AV285474.1, AV319299.1,
AV237769.1, AV222402.1, AV168848.1, AI536415.1, AI451945.1, AA964114.1, C86292.1, AA008923.1, W53783.1,
W13977.1, AL049840.3, AL139300.2, AC019143.3, AC025533.3, AC009695.4, AC025864.2, AC010845.7, AC008255.7,
AC012931.1, AC01 0973.3, AC022462.3, AL138781.2, AC069069.1, AC025468.3, AC025460.3, AC016590.5,
AC026467.3, AC008761.3, AC007779.2, AC026668.2, AC046154.1, AC025039.3, AC022051.3, AC018427.3,
AC025268.2, AC020884.2, AC012675.4, AC010564.5, AC010108.3, AC013664.1, AC017969.1, AC015824.2,
AC013259.1, AC008327.2, AC007936.1, AC004795.2, AC002344.1, AL157779.3, AL158078.2, AL162401.2,
AL160035.3, AL139013.2, AL139396.1, AP001888.1, AP001824.1,
SEQ ID NO: 356
ZH091/T3

NM_005552.1, L04733.1, U48359.1, M75148.1, M75147.1, M75146.1 NM_008450.1, AF055665.1, X69658.1, Y14586.1,
Z86099.2, AC007244.2, AL022238.1, U41356.1, AF077403.1, U97406.1, AC003973.1, U40232.1, AL135978.2,
AL161517.2, AL049524.1, X52606.1, AP000606.1, AB015478.1, AB026650.1, M34270.1, D56386.1, AI124665.1,
AI879287.1, AL134331.1, AA326459.1, AW249376.1, AU080282.1, AU079963.1, AU067583.1, AU067555.1,
AU035615.1, AA647015.1, AU067068.1, AA509865.1, AA230534.1, AU080666.1, AA015415.1, AU035489.1,
AA518630.1, AU076730.1, AW213300.1, AA410206.1, AU079968.1, AA615751.1, AA074408.1, N99532.1, AU079966.1,
AI840068.1, AU066979.1, AI576961.1, W40723.1, AU035788.1, AA611446.1, AI579813.1, AU051216.1, AI839935.1,
AI844836.1, AI835061.1, AI849047.1, AI838234.1, AI576664.1, AI715455.1, AI117342.1, AI710740.1, AW529922.1,
AI834986.1, AU035505.1, AW533285.1, W11435.1, AI8474 I5.1, AI787782.1, AL137941.1, AU078909.1, AI576960.1,

TABLE 1-continued

Sequence homologies (GenBank Accession Numbers)

AI839802.1, AI704444.1, AA853868.1, AI073056.1, AA839731.1, AA794.060.1, AA920796.1, AI837501.1, AI840457.1,
AI837150.1, AW533735.1, AA323263.1, AI643860.1, AI838411.1, AI837539.1, AW653245.1, AU066670.1, M85516.1,
AW343448.1, AW012089.1, AI929486.1, AI871196.1, AA692137.1, AL139300.2, AC023803.3, AC012160.5,
AL132666.3, AC020737.3, AC009088.4, AC019217.4, AC025828.1, AC021436.3, AC025369.1, U82207.1, AL355385.2,
AL136304.2, AC041049.2, AC053503.3, AC025581.1, AC022424.3, AC020982.3, AC010588.6, AC008622.4,
AC010269.3, AC008505.4, AC011443.4, AC009110.5, AC027670.2, AC027517.2, AC013581.4, AC027274.2,
AC062006.1, AC016881.4, AC040916.1, AC019266.3, AC025983.2, AC010823.3, AC025049.2, AC025539.2,
AC021214.3, AC023353.2, AC024429.2, AC019200.2, AC025726.1, AC023326.2, AC020715.2, AC023174.1,
AC022970.1, AC012356.3, AC018869.3, AC013569.3, AC006893.2, AC006097.1, AL355773.1, AL353680.3,
AL117376.27, AL161941.6, Z82209.1, AL158065.3, AL161942.3, AL133482.5, AL138689.1,
SEQ ID NO: 357
ZH091/T7

AF037222.1, AL049691.17, AC004492.1, AC002456.1, AC004888.1, AC005105.2, AC005377.2, A0005736.1,
AL161670.2, AL079342.17, Z97630.11, Z46773.1, AI652445.1, AI248698.1, AI969048.1, I96065.1, I96066.1,
AA825192.1, D29556.1, AA093428.1, N89272.1, AV211829.1, AW167973.1, AW109566.1, AI823090.1, AI792623.1,
AL047493.1, AI434780.1, AI381339.1, AI354333.1, AI153261.1, c89616.1, C87547.1, C87513.1, AA625193.1,
AA431864.1, AA224525.1, AA149590.1, AA146232.1, R97601.1, R90943.1, R89398.1, R83387.1, H47860.1, H11310.1,
R42599.1, R37029.1, Z22960.1, AL139300.2, AL049840.3, AL162211.3, AC027825.2, AC021087.2, AC068042.3,
AC023047.11, AC008264.7, AC011442.3, AC040897.2, AC022763.2, AC007430.17, AF232832.1, AC003117.1,
AL355821.2, AL355840.1, AL031731.25, AL355822.1, AL138898.4, AL132780.1, AL137781.3,
SEQ ID NO: 358
ZH1357/T3

AF037222.1, AL049691.17, AC004492.1, AC002456.1, AC004888.1, AC005105.2, AC005377.2, AC005736.1,
AL161670.2, AL079342.17, Z97630.11, Z46773.1, AI652445.1, AI248698.1, AI969048.1, T96065.1, T96066.1,
AA825192.1, D29556.1, AA093428.1, N89272.1, AV211829.1, AW657986.1, AW109566.1, AI792623.1, AL047493.1,
AI605406.1, AI434780.1, AI393981.1, AI381339.1, AI354333.1, AI054341.1, C89616.1, C87513.1, AA625193.1,
AA339052.1, AA232840.1, AA224525.1, AA149590.1, H65232.1, H57790.1, R97601.1, R90943.1, R89398.1, R83387.1,
H47860.1, H11310.1, R42599.1, R06801.1, AL139300.2, AL049840.3, AL162211.3, AC027825.2, AC021087.2,
AC068042.3, AC023047.11, AC008264.7, AC011442.3, AC040897.2, AC022763.2, AC007430.17, AF212832.1,
AC003117.1, AL355821.2, AL355840.1, AL031731.25, AL355822.1, AL138898.4, AL132780.1, AL137781.3,
SEQ ID NO: 359
ZH1361/T3

NM_005552.1, L04733.1, X69658.1, M75148.1, M75147.1, M75146.1, U48359.1, NM_008450.1, AF055665.1, YI4586.1,
AC007244.2, AL022238.1, U41356.1, NM_007764.1, AF108766.1, AF077403.1, AC003973.1, U40232.1, AL135978.2,
AL161517.2, AL049524.1, U19481.1, Y09072.1, X90648.1, AP000606.1, AB026650.1, M34270.1, DS6386.1, AI879287.1,
AW249376.1, AU076730.1, AL134331.1, AI124.665.1, AA853868.1, AA326459.1, AU080282.1, AU079963.1,
AU067583.1, AW213300.1, AU067555.1, AA647015.1, AU035615.1, AA509865.1, AA410206.1, AA230534.1,
AA015415.1, AU067068.1, AU035489.1, AA074408.1, N99532.1, AA5 38630.1, AU080666.1, AA615751.1, AU079968.1,
AU066979.1, AU079966.1, AI840068.1, AU03 5788.1, W40723.1, AI576961.1, AU051216.1, AI117342.1, AW529922.1,
AA611446.1, AI579813.1, AU035505.1, AI839935.1, AI844836.1, AI835061.1, AI787782.1, AI849047.1, AI838234.1,
AI576664.1, W11435.1, AJ715455.1, AU078909.1, AI710740.1, AI834986.1, AW533285.1, AA839731.1, AA794060.1,
AI847415.1, AA920796.1, AI839802.1, AI576960.1, AI704444.1, AI073056.1, AW533735.1, AI837501.1, AI840457.1,
AI837150.1, AA219531.1, AL137941.1, AU066670.1, AW653245.1, AW343448.1, AA263390.1, AI929486.1,
AW822022.1, AW741402.1, AW553351.1, AW547881.1, AW544029.1, AW540274.1, AW212176.1, AW046482.1,
AI882269.1, AI841137.1, AI447212.1, AA793909.1, AA726511.1, AA475518.1, AA444522.1, AA260228.1, AA220560.1,
AA158109.1, AA059905.1, W90906.1, W82825.1, W84293.1, AA051553.1, AA051548.1, AA032527.1, AA033314.1,
AA028401.1, W53289.1, AL139300.2, AC023803.3, AL132666.3, AC019217.4, AC025828.1, AC021436.3, U82207.1,
AL158822.4, AL354761.1, AC041049.2, AC022424.3, AC020982.3, AC01 0588.6, AC010269.3, AC008505.4,
AC011443.4, AC009110.5, AC027517.2, AC027274.2, AC016881.4, AC040916.1, AC019266.3, AC010823.3,
AC025049.2, AC025539.2, AC021214.3, AC023353.2, AC024429.2, AC019200.2, AC023326.2, AC020715.2,
AC023174.1, AC022970.1, AC012356.3, AC013569.3, AC006097.1, AL355773.1, AL353680.3, Z82209.1, AL158065.3,
AL133482.5, AL138689.1,
SEQ ID NO: 360
ZH156/T3

NM_005552.1, L04733.1, M75148.1, M75147.1, M75146.1, Y14586.1, NM_008450.1, AF055665.1, U48359.1,
AE003540.1, AF055298.1, L11328.3, L11013.1, NM_008451.1, AF055666.1, L47236.1, AC007244.2, NM_004812.1,
AC005027.2, AF052577.1, AC005369.1, L47235.1, AC002366.1, U37100.1, U41356.1, U18937.1, D88672.1,
AE003569.1, AE003505 .1, NM_012656.1, AF145609.1, AF125259.1, AFt 16268.1, AF093569.1, AC003973.1, U40232.1,
AJ243516.1, AJ251761.1, AL161517.2, AJ245739.1, AL049524.1, X14820.1, X84047.1, Y13714.1, X75972.1, Y14406.1,
X76785.1, AP000606.1, AB018494.1, M34270.1, AJ001448.1, AI124665.1, AL137941.1, AA326459.1, M85516.1,
AI579813.1, AI576961.1, AI840068.1, AW068178.1, AI715455.1, AI576664.1, AI839935.1, AI710740.1, AU080282.1,
AI844836.1, AI835061.1, M849047.1, AI838234.1, AA323263.1, AW533285.1, AU079963.1, AU080666.1, AI847415.1,
AI576960.1, AU067555.1, AI073056.1, AA611446.1, AI839802.1, AI704444.1, AL134331.1, D56386.1, AI834986.1,
AU067583.1, AU079968.1, AA230534.1, AI840457.1, AI837501.1, AI837150.1, W11435.1, AA509865.1, AA647015.1,
AA015415.1, AW533735.1, AL043408.1, AU067068.1, AU035615.1, AI838411.1, AI837539.1, AU079966.1,
AA518630.1, AI879287.1, AU035489.1, AI837589.1, AI643860.1, AW213300.1, F06922.1, AA615751.1, AU051216.1,
AU066979.1, AI834799.1, AW529922.1, AU035788.1, W40723.1, AA074408.1, AI117342.1, AA410206.1, N99532.1,
AW525818.1, AI602475.1, AI579543.1, AI579510.1, AI579008.1, AA964280.1, AA818427.1, AI101378.1, AW012089.1,
AA943900.1, AW653245.1, AW522687.1, AA997897.1, AI112976.1, AU035505.1, AA944331.1, AI787782.1,
AI641838.1, AA637666.1, AU078999.1, AA007747.1, AW184674.1, AI959425.1, AI199976.1, AA403503.1, AA920796.1,
AA839731.1, AU066670.1, AI554005.1, AI324825.1, AA442752.1, AW343448.1, AA871286.1, AI929486.1, AL139300.2,
AC023803.3, AL355385.2, AL136304.2, AP001812.1, AP001107.2, AP000630.1, AC017329.1, AP000759.2,
AC006448.10, AC055757.3, AC009276.7, AC025828.1, AC021436.3, U82207.1, AC041049.2, AC009661.3, AC022424.3,

TABLE 1-continued

Sequence homologies (GenBank Accession Numbers)

AC020982.3, AC010269.3, AC011443.4, AC009110.5, AC009022.5, AC027274.2, AC021876.3, AC016881.4,
AC040916.1, AC019266.3, AC016356.3, AC013782.3, AC010823.3, AC025049.2, AC0 32345.3, AC025539.2,
A0021214.3, AC023353.2, AC024429.2, AC011180.3, AC023375.2, AC007336.2, AC023326.2, AC020715.2,
AC011707.7, AC023174.1, AC022970.1, AC012356.3, AC019768.1, AC017606.1, AC013569.3, AC006097.1,
AL355773.1, AL353680.3, Z82209.1, AL158065.3, AL133482.5,
SEQ ID NO: 361
Splicing Factor Sip 1 SC35-interacting protin 1 (SRR129)

NM_005552.1, L04733.1, X69658.1, M75148.1, M75147.1, M75146.1 NM_008450.1, AF055665.1, U48359.1, Y14586.1,
AL022021.1, Z86099.2, AL022238.1, U41356.1, M72711.1, X64248.1 NM_007764.1, AF108766.1, AF077403.1,
AC003973.1, U40232.1, AL109663.1, AL135978.2, AL161517.2, S73375.1, AL049524.1, Y09072.1, AL021428.1,
X90648.1, X52606.1, AP000606.1, AB026650.1, M34270.1, D56386.1, AI879287.1, AW249376.1, AU076730.1,
AL134331.1, AA853868.1, AI124665.1, AA410206.1, AA074408.1, N99532.1, AA326459.1, AU080282.1, AU079963.1,
AU067583.1, AU067068.1, AU035615.1, AU067555.1, AU035489.1, AA647015.1, AU035415.1, AW213300.1,
AA518630.1, AA230534.1, AA509865.1, AA615751.1, AU080666.1, AU066979.1, AU079968.1, AU079966.1, W40723.1,
AU035788.1, AU051216.1, AW529922.1, AI117342.1, AU035505.1, AI840068.1, AI787782.1, AU078909.1, AI576961.1,
AA839731.1, AA794060.1, AI579813.1, W11435.1, AA920796.1, AI839935.1, AA611446.1, AI844836.1, AI835061.1,
AI849047.1, AI838234.1, AI576664.1, AI715455.1, M710740.1, AI834986.1, AW533285.1, AI847415.1, AI839802.1,
AI576960.1, AA219531.1, AI704444.1, AI073056.1, AI840457.1, AI837501.1, AI837150.1, AU066670.1, AW533735.1,
AA263390.1, AI939480.1, AI812211.1, AI418988.1, AW822022.1, AW741402.1, AW553351.1, AW547881.1,
AW544029.1, AW540274.1, AI882269.1, AI871196.1, AI841137.1, AI447212.1, AA793909.1, AA692137.1, AA475518.1,
AA444522.1, AA260228.1, AA158109.1, AA059905.1, W90906.1, W82825.1, AA051553.1, AA033314.1, W53289.1,
AL139300.2, AC023803.3, AC012160.5, AC008687.3, AL132666.3, AC019217.4, AC025828.1, AC021436.3,
AC025369.1, U82207.1, AL158822.4, AL354761.1, AC041049.2, AC068666.1, AC020982.3, AC010588.6, AC008622.4,
AC008505.4, AC011443.4, AC009110.5, AC027517.2, AC027274.2, AC016881.4, AC040916.1, AC019266.3,
AC025983.2, AC010823.3, AC025049.2, AC025539.2, AC021214.3, AC023353.2, AC024429.2, AC019200.2,
AC023326.2, AC020715.2, AC023174.1, AC012356.3, AC013569.3, AC006097.1, AL355773.1, AL353680.3, Z82209.1,
AL158065.3, AL133482.5,
SEQ ID NO: 362
ZH062/T3

NM_004719.1, AF030234.1, , er of s . . . 1001 0.0, AC000015.2, U32169.1, U41066.1, U97190.1, AF004910.1, AC006160.9,
AC005752.1, AF048702.1, AF047519.1, AF047518.1, , U39472.1, L05083.1, L05082.1, L05081.1, U17500.1,
NC_001137.2, AC010972.2, AC024756.1, AE003765.1, AF187095.1, AC002406.1, U34874.1, U18530.1, M63543.1,
M63544.1, M27242.1, L26545.1, AA319947.1, AI538495.1, AA003764.1, ryo NbME1 . . . 117 4e-24, AW611398.1,
AW414066.1, AA919730.1, AA571070.1, AA103126.1, ryo 13 . . . 1152e-23, AW835334.1, AI504981.1, AW271488.1,
AW249666.1, AI681365.1, AI273392.1, AI251837.1, W56462.1, AW782740.1, AW2845 26.1, AV091886.1, C66973.1,
AA290444.1, N98074.1, AC010172.10, AC064878 3, , AC068734.1, AC026445.2, AC010420.4, AC046142.3,
AC013546.3, AC068309.1, AC068040.1, AC024465.3, AC026931.2, AC016388.2, AC044799.2, AC061962.1,
AC013645.3, AC024422.2, AC021913.4, AC0L2203.4, AC013577.2, , AC068196.2, AC023968.2, AC068563.3,
AC026428.2, AC025189.3, AC008411.3, AC011123.4, AC026470.3, AC011320.7, AC027466.2, AC055777.1,
AC046192.1, AC025981.2, AC016773.4, AC016768.4, AC023854.2, AC025123.1, AC009213.4, AC023306.1,
AC011996.3, AC011897.3, AC018467.3, AC013383.1, AF127019.2, AC014412.1, AC009707.2, AC006735.3,
AP001999.1, AP001562.1,
SEQ ID NO: 363
ZH062/T7

AC000015.2, NM_004719.1, Y11251.1, AF030234.1, AL117351.12, AL139076.2, AC007092.4, AL031770.12, Z68295.1,
AL163273.2, Z78012.1, Z93930.10, AP001728.1, AP001432.1, AP000151.1, AB015474.1, AP000010.2, NM_004505.3,
AE003658.1, AC004841.2, AF003140.2, U87145.2, AC006471.1, U21319.1, AF070575.1, AF057037.1, AC000114.1,
AL139229.1, AL034356.1, AL023513.1, AL117201.1, AL117325.3, AI243961.1, Z81145.1, AL031675.1, Z83306.1,
AL117264.1, U56248.1, AJ235272.1, X63547.1, X63546.1, X60459.1, AP000188.1, AP000044.1, AP000296.1,
AB026661.1, AP000112.1, AB018263.1, X92982.1, AA889580.1, AW467027.1, AI753624.1, AI765502.1, AI015579.1,
AI742080.1, AW439997.1, AI808732.1, AI624350.1, R56692.1, R76730.1, D81292.1, I158206.1, R66856.1, AW393523.1,
AA478518.1, AW393555.1, AA459830.1, AW361894.1, AW073290.1, AI935778.1, AI524518.1, AI559753.1, H78241.1,
AA604972.1, H01374.1, AI338117.1, M926706.1, AI084031.1, AI039125.1, AI411610.1, AW525397.1, AA901402.1,
AI012492.1, AI179529.1, AA4.61606.1, W60077.1, AW611398.1, AW413730.1, AW228936.1, AV363637.1, AV311516.1,
AV295190.1, AW123947.1, AI644515.1, AI462454.1, AI426341.1, AA867131.1, AA266876.1, AA203781.1, AA146549.1,
AV311392.1, AI394321.1, AV121897.1, AI706625.1, AW599493.1, AW443257.1, AV300621.1, AV384018.1,
AW094581.1, AL041793.1, AV144773.1, AI690341.1, AI580260.1, AA997487.1, AI407787.1, AA892897.1, AI152857.1,
AI147443.1, AA922552.1, AA878323.1, AA586210.1, AA328622.1, H09769.1, R43439.1, R42709.1, R44588.1, R39341.1,
R38267.1, P10638.1, AC010172.10, AL136998.11, AL133400.6, AC007158.8, AC024622.3, AL138738.1, AC022106.2,
AC008597.4, AC019243.3, AC020973.1, AC009935.1, AL096873.2, AC021863.4, AC017100.3, AC016378.4,
AC025102.1, Z99775.8,
SEQ ID NO: 364
ZH085/T3

NM_004719.1, AF030234.1, Y11251.1, AC000015.2, AL117351.12, U49056.1, AC008127.10, AC007399.1, AL109938.8,
AP000003.1, NC_001140.2, AF229844.1, AC005998.3, AC006984.2, AF189155.1, AC006008.2, AC006948.4,
AC005599.5, U23515.1, AC002350.1, U00027.1, AL163299.2, AL163261.2, AL117325.3, AL033127.1, Z19157.1,
101323.1, U08988.1, AP001754.1, AP001716.1, AP001067.1, AP000188.1, AB023497.1, AP000043.1, AP000295.1,
AP000112.1, AW361894.1, AI935778.1, AW073290.1, AA459830.1, AI084031.1, AA461606.1, AI524518.1,
AW316950.1, AI000658.1, AI453007.1, AW628965.1, AI922403.1, AW088601.1, AW083302.1, C84289.1, H78241.1,
W52849.1, AW241802.1, AA319619.1, AA867131.1, AW467027.1, D81292.1, AI179529.1, AI012492.1, AW525397.1,
AI990580.1, AI352557.1, H62920.1, R91171.1, AA574243.1, AA901402.1, AI411610.1, AI002763.1, AA093717.1,
AA384066.1, AA296633.1, AW390895.1, AI426341.1, AW228936.1, AW123947.1, AI152857.1, AA272113.1,
AI120842.1, AI644515.1, AI462454.1, AA093740.1, AA692961.1, AA600109.1, AA146549.1, AA203781.1, AA359862.1,

TABLE 1-continued

Sequence homologies (GenBank Accession Numbers)

W08813.1, T96952.1, R76730.1, R56692.1, R66856.1, AA359831.1, AA889580.1, AA290444.1, AI154265.1,
AA359605.1, AI643169.1, AA561434.1, AI808732.1, AI504929.1, AA374554.1, AA266876.1, AI706625.1, AJ394321.1,
AW611398.1, AI624350.1, AC010172.10, AC025996.3, AC019038.3, AC068939.1, AC022148.4, AC016934.3,
AC027273.2, AC025215.1, AC022025.1, AC009522.2, AL355360.2, AL353593.3, AL160407.3, AL139003.1,
AL035456.23, AC027605.4, AC018351.7, AC023277.3, AC067958.2, AC008723.5, AC011418.3, AC018647.1,
AC009333.8, AC026319.2, AC034141.2, AC018932.5, AC022469.3, AC025840.2, AC025144.2, AC026280.2,
AC021774.3, AC011029.3, AC015458.3, AC009545.3, AC024186.3, AC021011.2, AC021308.3, AC008519.2,
AC015758.3, ACJ018790.3, AC012307.2, AC021333.1, AC018561.2, AC016110.1, AC006878.2, AL355540.1,
AL354750.2, AL139042.2, AL161444.2, AL136163.3, AL138719.1, AL137121.3, AP001638.1,
SEQ ID NO: 365
ZH085/T7

AC000015.2, U28371.1, AP001047.1, AC006101.3, AC009223.2, AL132979.2, AL031586.2, U29376.1, AB017066.1,
AC002337.2, AC008173.2, AC008124.8, AC005826.1, AL032657.1, U40938.1, AP000233.1, AB020878.1, AW003511.1,
AA921845.1, AI652147.1, AI693426.1, AI829962.1, AI434429.1, AA573137.1, AI332526.1, AI183429.1, AI435449.1,
AI189561.1, AI378034.1, AI2219621, N47325.1, AW118897.1, N41605.1, N48812.1, AW665247.1, AW340077.1,
N29605.1, AA478519.1, AW190293.1, AA463875.1, AI292305.1, AA971089.1, AA463379.1, AA884954.1, AI858260.1,
AI382934.1, AA931835.1, AI125820.1, AI125702.1, AI358631.1, AI080245.1, AI027833.1, AW021929.1, AI399648.1,
AA769041.1, AW372265.1, AA738261.1, N67374.1, AI014533.1, N69081.1, AA459715.1, AA347851.1, AW439905.1,
D12465.1, AI768667.1, I188007.1, AA948472.1, D56771.1, AI819214.1, I122651.1, AA293133.1, H21980.1, H42880.1,
H22650.1, AI186725.1, AA889214.1, I488179.1, AI492769.1, D56772.1, H87354.1, D56691.1, I122043.1, H87486.1,
AW628965.1, AA600109.1, AA574243.1, AI453007.1, AI222635.1, H16217.1, AW241802.1, AW083302.1, I125165.1,
AA095911.1, H44052.1, AI376308.1, H42946.1, AW429971.1, AV346363.1, R34052.1, AW271826.1, AV366809.1,
AV354759.1, AV344488.1, AV298108.1, AV116868.1, R33250.1, AV355258.1, AV235683.1, AC010172.10,
AC007511.2, AC013660.4, AC020193.1, AC011141.2, AC018353.10, AC068723.1, AC027044.2, AC025863.2,
AC021531.3, AC013748.3, AL161932.4, AC022217.3, AC019116.3, AC021362.4, AC021644.3, AC021159.2,
AC017103.3, AC021986.1, AC010935.2, AC009741.4,
SEQ ID NO: 366
ZH1244/T3

NM_004719.1, AF147405.1, AC000015.2, AF030234.1, Y11251.1, U16782.1, AL136419.2, AL111164.1, AE003490.1,
AF045341.1, ALL21841.5, NC_001143.1, AC010283.5, AE003681.1, AF090924.1, AC006389.2, AC003950.1,
AC004099.1, U16855.1, AL122013.3, Z69712.2, X76174.1, Z28239.1, L11172.1, AB013190.1, D83502.1, AB000162.1,
AW152460.1, AI969507.1, AW084759.1, AI986247.1, AI811466.1, AI590951.1, AI984932.1, AI457465.1, T34545.1,
AA903034.1, AI915886.1, AA938734.1, AA812235.1, AW083255.1, T68840.1, M79122.1, AI934225.1, AA376018.1,
F13709.1, AI475277.1, T68912.1, AA767811.1, T40900.1, AA103126.1, H30589.1, AW824184.1, AW556003.1,
AW228186.1, AW414066.1, AI098240.1, AV252704.1, AV321035.1, AI790543.1, AV319958.1, AW227799.1,
AV356664.1, AA407099.1, AA871902.1, AA616747.1, AI108941.1, AA140172.1, AW611398.1, AA836742.1,
AA019444.1, AA012812.1, AC010172.10, AC021642.1,1, AC068273.2, AC015669.4, AC022310.2,
AC021978.4, AC016866.3, AC012445.3, AC020072.1, AP000799.1, AP000641.1, AC025652.2, AC069063.1,
AC016919.4, AC068892.1, AC010448.4, AC066310.1, AC027233.2, AC021484.3, AC012246.3, AC022714.2,
AC023929.2, AC022895.2, AC006583.17, AC011966.2, AC013753.2, AC014256.1, AL137795.2, AP000941.2,
AP000869.1, AP000846.1, AP000831.1,
SEQ ID NO: 367
ZH1323/T3

NM_004719.1, AF030234.1, Y11251.1, AC000015.2, U32169.1, U41066.1, AL031228.1, AC006160.9, AL161537.2,
AL035593.11, Z97335.2, U97190.1, AC004993.1, AF004910.1, AC005752.1, AF048702.1, AF047519.1, AF047518.1,
AJ249381.1, U39472.1, L05083.1, L05082.1, L05081.1, U17500.1, Z94043.1, Z99121.1, X02730.1, NC_001137.2,
AC024756.1, AE003765.1, AC002406.1, U34874.1, U18530.1, U07562.1, AL050343.17, AL032640.1, Z29443.1,
Z82270.1, Z50858.1, Z70225.1, L42315.1, M63543.1, M63544.1, M27242.1, L26545.1, AA319947.1, AI538495.1,
AW835334.1, AW611398.1, AW414066.1, AA919730.1, AA571070.1, AA003764.1, W52849.1,
AI504981.1, AA290444.1, AW271488.1, AW249666.1, M681365.1, P.1454944.1, AI273392.1, AI251837.1, AI226601.1,
W56462.1, AW284526.1, AW236061.1, AV091886.1, C82282.1, 066973.1, N98074.1, R04117.1, AC010172.10,
AC064878.3, AL158134.5, AC068734.1, AC026445.2, AC046142.3, AC013546.3, AC068309.1, AC068040.1,
AC026931.2, AC016388.2, AC044799.2, AC061962.1, AC013645.3, AC024422.2, AC021913.4, AC012203.4,
AC013577.2, AL354739.3, AC025189.3, AC026470.3, AC011320.7, AC068154.1, AC046192.1, AC025981.2,
AC015916.3, AC025921.1, AC021002.3, AC016768.4, AC017029.4, AC013579.4, AC013777.3, AC025123.1,
AC021754.3, AC011330.5, AC020568.2, AC009213.4, AC023306.1, AC011996.3, AC018467.3, AF127019.2,
AC014412.1, AC009707.2, AL035406.21, AL121876.26, AL355388.1, AP001562.1, AP001460.2, Z96103.1, AL031113.1,
SEQ ID NO: 368
ZH1406/T3

NM_004719.1, AF030234.1, Y11251.1, AC000015.2, U49056.1, AE003801.1, AE003791.1, AC008127.10, AF004910.1,
AF030105.1, AF048702.1, AF047519.1, AF047518.1, AC004640.1, AL109938.8, A3249381.1, AL022327.17, L05083.1,
L05082.1, L05081.1, U17500.1, AP000003.1, Z94043.1, Z99121.1, X02730.1, U13618.1, NC_001140.2, AC009113.3,
AE003442.1, AF189155.1, AC006552.7, AF085356.1, AC005599.5, AF093117.1, U23515.1, AC002350.1, U34874.1,
U00027.1, AL163299.2, AL163261.2, Z97055.1, AL033127.1, L42315.1, J01323.1, U08988.1, AP001754.1, AP001716.1,
AP001067.1, AP000188.1, AB023497.1, AP000043.1, AP000295.1, AP000112.1, AB018331.1, AW628965.1,
AW088601.1, AI453007.1, AI000658.1, AI922403.1, AW316950.1, AI935 778.1, AA461606.1, AI084031.1, AW361894.1,
AA384066.1, AA296633.1, AW083302.1, AA359862.1, AA359831.1, AA359605.1, AA319619.1, AW073290.1,
AW241802.1, W52849.1, AA374554.1, AA867131.1, AI538495.1, AA459830.1, W08813.1, AW835334.1, C84289.1,
AI990580.1, AI352557.1, H62920.1, R91171.1, AA574243.1, AA692961.1, AA290444.1, AA272113.1, AI462454.1,
AI120842.1, AW390895.1, AA093717.1, AI002763.1, AI524518.1, AA093740.1, AA003876.1, AI179529.1, AA600109.1,
AW228936.1, T96952.1, M426341.1, AI012492.1, AA359840.1, R91221.1, AW123947.1, M152857.1, AI411610.1,
AW525397.1, AI644515.1, W86494.1, AA901402.1, AA146549.1, H78241.1, AI504981.1, AA203781.1, AI154265.1,
AA990247.1, AA003764.1, AI643169.1, AW802816.1, AW693307.1, AW476333.1, AW401588.1, AU074395.1,

TABLE 1-continued

Sequence homologies (GenBank Accession Numbers)

AI198894.1, AA326042.1, AA219378.1, R20933.1, RI 8569.1, AC010172.10, AL133159.3, AL133160.1, AC025996.3,
AC068939.1, AC040935.2, AC011398.4, AC016934.3, AC018412.3, AC009970.6, AC025215.1, AC022025.1,
AC020112.1, AC017181.1, AC009522.2, AL355522.2, AL355360.2, AL161910.3, AL160407.3, AL138722.5,
AL136125.2, AL035456.23, AL135909.3, AC068643.5, AC067731.3, AC026998.2, AC068642.2, AC023277.3,
AC067958.2, AC008723.5, AC010315.4, AC016642.4, AC008538.4, AC008491.4, AC008461.4, AC032010.2,
AC026319.2, AC012322.4, AC027501.2, AC068154.1, AC019172.3, AC009856.2, AC026988.2, AC018932.5,
AC025840.2, AC025144.2, AC021606.3, AC034275.1, AC025931.2, AC021774.3, AC015458.3, AC024186.3,
AC021002.3, AC021011.2, AC021308.3, AC008519.2, AC018790.3, AC021188.2, AC007603.1, AC017099.3,
AC018561.2, AF214634.1, AC008130.5, AC016110.1, AC014356.1, AC009413.1, AC006878.2, AC003656.1,
AL355611.2, AL355540.1, AL354750.2, AL139042.2, AL161444.2, AL138719.1, AL109948.2, AP001638.1, AP001452.1,
AP001406.1, AP001271.1, AP001205.1, AP000896.1,
SEQ ID NO: 369
RPB-Jx

L07872.1, L34544.1, L34543.1, M81871.1, S63463.1, X17459.1, Z36843.1, NM_015874.1, L08904.1, D14041.1,
L07873.1, L07876.1, X59130.1, U60094.1, U60093.1, X59129.1, M81869.1, L07875.1, L07874.1, X58337.1, M81866.1,
M81870.1, M81867.1, M81872.1, M81865.1, M81873.1, M81874.1, AF100663.1, U49795.1, U49794.1, AE003646.1,
AE003411.1, AF085173.1, AF047659.1, AB003695.1, AE002261.1, AE001663.1, AB035943.1, AC011288.3,
AC007729.2, AC002338.2, AE003505.1, AC006978.2, AE002049.1, AC005351.1, AF003130.1, Y08501.1, AL031680.17,
Z93928.1, X66728.1, X65871.1, AI007973.1, X69871.1, X58393.1, M94383.1, AC010682.2, AE003601.1, AC024864.1,
AC024206.1, U09118.1, NM001813.1, AC012329.3, AE002002.1, U22418.1, AC000100.2, AC000093.3, U50390.1,
AF104919.1, AF015788.1, U57053.1, AC002375.1, AC002444.1, AL355836.1, AL161587.2, AL161492.2, AL132964.2,
AL137898.1, AL132962.1, Z71185.1,555498.1, AL035581.1, Z93385.1, Z81086.1, AL031785.1, AL035445.4, U70855.1,
Z15005.1, AB027454.1, M81868.1, X60772.1, X96762.1, AL031135.1, AI325751.1, AW239382.1, AA101254.1,
U69195.1, AA171575.1, AA081973.1, AA101350.1, AA332410.1, AI766488.1, T67576.1, T19153.1, D58647.1,
AI190097.1, R44578.1, F01398.1, 23712.1, R37405.1, AA547961.1, AW462450.1, R30693.1, AW250553.1, I79039.1,
170135.1, AA935398.1, AA080102.1, AA429185.1, AW084668.1, AA817421.1, AI916589.1, AW801962.1, AW299030.1,
AW250554.1, AI142713.1, AA971158.1, AA948444.1, AA736032.1, C12590.1, R71133.1, AW760949.1, AW619132.1,
AW568358.1, AW567572.1, AW508325.1, AW493651.1, AW488718.1, AW488466.1, AW472135.1, AW471527.1,
AW397878.1, AW397422.1, AW397379.1, AW390735.1, AW318250.1, AW307273.1, AW277776.1, AW221760.1,
AW093987.1, AI995809.1, AV200012.1, AV198387.1, AV191304.1, AI846915.1, AU075765.1, AI779257.1,
AU069114.1, C65393.1, AA203664.1, W90492.1, W84832.1, D73771.1, D69291.1, D68255.1, H66535.1, I166386.1,
H49719.1, R00639.1, T95219.1, D48403.1, D48356.1, D37730.1, D22894.1, AL356136.1, AC044869.2, AC016175.1,
AC006391.7, AC019747.1, AC026702.3, AC015644.3, AC015641.3, AC063967.1, AC011359.3, AC025287.2,
AC021871.7, AC024734.3, AC024447.2, AC021230.3, AC021195.3, AC017011.3, AC011934.5, AC010780.3,
AC025363.1, AC025099.1, AC013432.3, AC012096.7, AC010147.4, AC021313.1, AC013569.3, AC013105.1,
AC006714.2, AL162291.7, AL353653.4, AP001377.1,
SEQ ID NO: 370
ZH121/T3

L07872.1, L24544.1, L24543.1, S63463.1, X17459.1, M81871.1, NM_015874.1, L08904.1, D14041.1, L07873.1,
X59130.1, U60094.1, U60093.1, X59129.1, M81869.1, M81870.1, M81867.1, M81872.1, M81873.1, M81874.1,
AE003646.1, AE003411.1, AF085173.1, AF047659.1, Z36843.1, AB003695.1, AC011288.3, AC007729.2, AC002338.2,
AC006978.2, AF100663.1, AF003130.1, Y08501.1, Z93928.1, U49795.1, X66728.1, X65871.1, AJ007973.1, X58393.1,
M94383.1, AC010682.2, AF223391.1, AC024864.1, AC024206.1, NM_001813.1, AC012329.3, U22418.1, AC000100.2,
AC000093.3, AF104919.1, AL355836.1, AL161587.2, AL161492.2, AL132964.2, AL137898.1, AL132962.1, AL035581.1,
Z93385.1, Z81086.1, AL035445.4, U70855.1, U49794.1, Z15005.1, M81868.1, X96762.1, AL031135.1, AI325751.1,
U69195.1, AW239382.1, AA081973.1, AA101254.1, T19153.1, AA101350.1,R44578.1, F01398.1, AA171575.1,
123712.1, R37405.1, AA332410.1, T67576.1, AW462450.1, T79039.1, T70135.1, AA935398.1, AA547961.1, AI766488.1,
AA429185.1, AW084668.1, AA817421.1, AI190097.1, AI916589.1, AW801962.1, AI142713.1, AA736032.1, R71133.1,
AW760949.1, AW221760.1, AW093987.1, AI995809.1, AV200012.1, AV198387.1, AV191304.1, AI779257.1, C65393.1,
AA203664.1, C12590.1, W90492.1, W84832.1, D73771.1, D69291.1, D68255.1, I166535.1, I166386.1, H49719.1,
R00639.1, T95219.1, D37730.1, AL356136.1, AC006391.7, AC016175.1, AC019747.1, AC015644.3, AC015641.3,
AC063967.1, AC021871.7, AC024734.3, AC024447.2, AC021195.3, AC017011.3, AC01 0780.3, AC025099.1,
AC010147.4, AC021313.1, AC013569.3, AC006714.2, AP001377.1, AC009716.3, AC055764.2, AC068491.1,
AC068028.1, AC005077.2, AC007273.3, AC008267.3, AC055790.1, AC025889.2, AC016462.3, AC027268.1,
AC024560.4, AC022793.2, AC018681.5, AC022938.3, AC023815.2, AC013504.2, AC006904.2, AC006900.1,
AC006719.1, AP001455.1, AP001445.1, AL009206.1,
SEQ ID NO: 371
ZH1255/T3

Z36843.1, L07876.1, L07873.1, L34544.1, L07872.1, L345431 NM_015874.1, L08904.1, D14041.1, M81871.1,
S63463.1, X17459.1, L07875.1, L07874.1, M81866.1, X59129.1, U60093.1, U60094.1, X59130.1, M81867.1, M81865.1,
AF100663.1, U49795.1, U49794.1, X58337.1, AE002261.1, AE001663.1, AB035943.1, AE003505.1, AC005351.1,
X69871.1, AC010682.2, AC000100.2, U50390.1, Z71185.1, 555498.1, AL031785.1, AJ009961.1, AB005243.1,
AI766488.1, AW239382.1, AA332410.1, D58647.1, AA171575.1, T67576.1, AI190097.1, AA547961.1, AA101254.1,
AI325751.1, AA101350.1, R30693.1, AA081973.1, AW250553.1, T19153.1, AA080102.1, U69195.1, R44578.1,
F01398.1, R37405.1, T23712.1, AW299030.1, AW250554.1, AA971158.1, AA948444.1, C12590.1, AW390735.1,
AI408535.1, AC044869.2, AC016175.1, AC006391.7, AL356136.1, AC011359.3, AC025287.2, AC007037.3,
AC021230.3, AC011934.5, AC025363.1, AC013432.3, AC012096.7, AC013105.1, AL162291.7, AC009716.3,
AC068641.3, AC018642.3, AC009783.6, AC023774.3, AC007273.3, AC027042.2, AC017098.2, AC022721.3,
AC018525.4, AC024631.1, AC022321.3, AC016341.1, AL160011.4, AU38884.3, AL133240.1, AL121773.1,
AP001445.1, AL008875.1,

TABLE 1-continued

Sequence homologies (GenBank Accession Numbers)

SEQ ID NO: 372
ZH1314/T3

Z36843.1, L07876.1, L07873.1, L34544.1, L34543.1, NM_015874.1, L08904.1, D14041.1, L07872.1, M81871.1,
S63463.1, X17459.1, L07875.1, L07874.1, X58371.1, X59129.1, M81866.1, X59130.1, U60094.1, U60093.1, M81865.1,
AE003505.1, AE002049.1, AL031680.17, X69871.1, AE003601.1, AE003582.1, AE002261.1, AC004159.1, U09118.1,
AC008047.3, AE002002.1, AC011622.4, AE001663.1, U50390.1, AF015788.1, U57053.1, AC002375.1, AC0024.44.1,
Z71185.1, S55498.1, AL031785.1, AL009175.1, AB027454.1, AB035943.1, X60772.1, AI766488.1, D58647.1,
AW239382.1, AI190097.1, AA547961.1, AA332410.1, AA171575.1, T67576.1, R30693.1, AW250553.1, AI325751.1,
AA080102.1, AA101254.1, AA101350.1, AA081973.1, AW299030.1, AW250554.1, AW730270.1, AW727121.1,
AW726947.1, AW619132.1, AW568358.1, AW567572.1, AW508325.1, AW493651.1, AW488718.1, AW488466.1,
AW472135.1, AW471527.1, AW431366.1, AW397878.1, AW397422.1, AW397379.1, AW390735.1, AW318250.1,
AW307273.1, AW277776.1, AW109344.1, AI84.6915.1, AU075765.1, AI731058.1, AI729101.1, AI726880.1,
AU069114.1, D48403.1, D48356.1, T19153.1, D22894.1, AC044869.2, AC016175.1, AC006391.7, AC026702.3,
AC007256.2, AC021334.1, AC016185.1, AC068563.3, AC025765.3, AC008411.3, AC025363.1, AC013432.3,
AC012096.7, AC013105.1, AL162291.7, AL353653.4, AC068951.1, AC026986.2, AC023250.3, AC027042.2,
AC025941.2, AC011571.3, AC013548.2, AC026266.1, AC024104.3, AC022321.3, AC012045.4, AC021459.1,
AC018189.1, AC019977.1, AC009909.3, AC016341.1, AC012279.1, AC011252.3, AL159988.4, AL138884.3,
AL138748.4, AL135920.5, AL133267.4, ALL21944.14, AL135818.2, AL133153.1, AL008875.1,

SEQ ID NO: 373
ZH1314/T7

L34543.1, L07872.1, L34544.1, NM_015874.1, L08904.1, D14041.1, S63463.1, X17459.1, M81871.1, U60093.1,
U60094.1, M81877.1, L07873.1, M81876.1, AE003830.1, AC005974.1, AL021578.1, AB024964.1, AB026048.1,
AC012397.30, AC012147.7, AC007270.2, AC005839.1, AF049850.1, AF016494.1, D25323.1, X75598.1, D90170.1,
D90168.1, M64933.1, AA641661.1, AW090508.1, AI627646.1, AI953614.1, AI962712.1, AI401150.1, AW131544.1,
AA701607.1, AW302357.1, AI829826.1, AA501219.1, AA042864.1, AI984992.1, AA640106.1, AA903408.1,
AA483607.1, AW249681.1, AW235086.1, AI381502.1, AA069672.1, AI619912.1, AI291840.1, AI023923.1, T67414.1,
M580826.1, AI375729.1, AI565611.1, AW425207.1, AI334962.1, AI334964.1, M669755.1, N95392.1, AW005947.1,
AI144435.1, AW815621.1, AI982567.1, AA788576.1, AA171398.1, P33435.1, AI631440.1, AA669918.1, AW815443.1,
AA101255.1, AW391454.1, AA676341.1, AW815833.1, AA169326.1, AA101351.1, AW391447.1,
U69195.1, AW815635.1, AA908462.1, AA126685.1, AW815508.1, AW249892.1, AW801962.1, AW815506.1,
AW815512.1, AW609613.1, AA044415.1, AA678797.1, AW462450.1, AW381515.1, AW474060.1, AW381537.1,
AA156824.1, R12509.1, AW379059.1, AW371260.1, AI720441.1, AW189578.1, AW3713781, L23713.1, AW381482.1,
AW381510.1, AW381496.1, AA705248.1, I70135.1, R19314.1, AW381476.1, F05151.1, AI206928.1, AW381459.1,
AW843169.1, AW610177.1, AW393428.1, AW016196.1, AW009270.1, AA092442.1, R45471.1, H19326.1, AI435870.1,
AI274998.1, AI095803.1, AA235124.1, AA234950.1, W25228.1, AI919572.1, AW384329.1, AC006391.7, AC016175.1,
AL356136.1, AC017078.3, AC017144.1, AL162420.3, AC051628.10, AC007849.6, AC068789.2, AC012480.4,
AC009192.59, AC010552.3, AC022926.2, AC023391.2, AC015797.2, AL354999.1, AL160035.3, AL159978.2,
AP001532.1, AP001400.1, AP001005.1, AP000590.3,

SEQ ID NO: 374
ZH1321/T3

L07872.1, L24544.1, L24543.1, 563463.1, X17459.1, M81871.1, NM_015874.1, L08904.1, D14041.1, L07873.1,
X59130.1, X59129.1, U60094.1, U60093.1, M81869.1, M81870.1, M81867.1, Z36843.1, M81866.1, AF100663.1,
U49795.1, U49794.1, AE003646.1, AE003411.1, AF085173.1, AF047659.1, M81872.1, AB003695.1, AC011288.3,
AC007729.2, AC002338.2, AC006978.2, AF003130.1, Y08501.1, X66728.1, X65871.1, AJ007973.1, X58393.1,
M94383.1, AC010682.2, AF223391.1, AC024864.1, AC024206.1, NM_001813.1, AC012329.3, U22418.1,
AC000100.2, AF104919.1, AL355836.1, AL136527.1, AL161587.2, AL161492.2, AL132964.2, AL137898.1,
AL132962.1, AL035581.1, Z93385.1, Z81086.1, AL035445.4, U70855.1, Z15005.1, M81868.1, X96762.1,
AL031135.1, AI325751.1, AW239382.1, AA101254.1, AA081973.1, U69195.1, AA101350.1, T19153.1, AA171575.1,
R44578.1, F01398.1, L23712.1, AA332410.1, R37405.1, T67576.1, AA547961.1, AW462450.1, AI766488.1,
AA935398.1, T79039.1, T70135.1, AI190097.1, AA429185.1, AA817421.1, AA080102.1, AI142713.1, AA971158.1,
AA948444.1, AA736032.1, C12590.1, R71133.1, AW760949.1, AW221760.1, AW093987.1, AI995809.1,
AV200012.1, AV198387.1, AV191304.1, AI779257.1, C65393.1, AA203664.1, W90492.1, W84832.1, D73771.1,
D69291.1, D68255.1, H66535.1, H66386.1, H49719.1, R00639.1, T95219.1, D37730.1, AL356136.1, AC006391.7,
AC016175.1, AC019747.1, AC015644.3, AC015641.3, AC063967.1, AC025287.2, AC021871.7, AC024734.3,
AC024447.2, AC021230.3, AC021195.3, AC017011.3, AC011934.5, AC010780.3, AC025099.1, AC010147.4,
AC013569.3, AC006714.2, AP001377.1, AC009716.3, AC055764.2, AC068028.1, AC005077.2, AC007273.3,
AC008267.3, AC055790.1, AC025889.2, AC016462.3, AC027268.1, AC018379.3, AC025135.2, AC024560.4,
AC025141.2, AC022793.2, AC018681.5, AC022938.3, AC023815.2, AC013504.2, AC006904.2, AC006900.1,
AC006719.1, AP001575.1, AP001455.1, AP001445.1, AL009206.1,

SEQ ID NO: 375
ZH168/T3

Z36843.1, L07872.1, L07876.1, L34544.1, L24543.1, L07873.1, MB1871.1, S63463.1, X17459.1, NM_015874.1,
L08904.1, D14041.1, L07875.1, L07874.1, M81866.1, X59129.1, U60093.1, U60094.1, X59130.1, M81867.1, M81869.1,
M81865.1, X58337.1, AF100663.1, U49795.1, U49794.1, AE002261.1, AE001663.1, AB035943.1, AC011288.3,
AE003505.1, AC005351.1, X69871.1, NM_001813.1, AC010682.2, U22418.1, AC000100.2, U50390.1, Z71185.1,
AL031785.1, 555498.1, Z15005.1, M81868.1, AW239382.1, AA171575.1, AA332410.1, M766488.1, AA101254.1,
T67576.1, AA101350.1, D58647.1, AI190097.1, AA081973.1, AI325751.1, AA547961.1, TI9153.1, R30693.1, R44578.1,
U69195.1, F01398.1, T23712.1, R37405.1, AW250553.1, AA080102.1, AA429185.1, M585405.1, AA542353.1,
AW299030.1, AW250554.1, AA971158.1, AA948444.1, C12590.1, AW390735.1, AA203664.1, W90492.1, W84832.1,
H66535.1, H66386.1, H49719.1, R00639.1, T95219.1, AC044869.2, AC006391.7, AL356136.1, AC016175.1,
AC026705.3, AC011359.3, AC025287.2, AC021230.3, AC021195.3, AC013432.3, AC011934.5, AC012096.7,
AC025363.1, AC013105.1, AL162291.7, AP001377.1, AC009716.3, AC040929.2, AC018642.3, AC009783.6,

TABLE 1-continued

Sequence homologies (GenBank Accession Numbers)

AC068028.1, AC023774.3, AC027042.2, AC007273.3, AC025496.2, AC022793.2, AC018681.5, AC022938.3,
AC022321.3, AC016341.1, AL138884.3, AP001445.1, AL008875.1
SEQ ID NO: 376
ZH1277/T3

NM_013285.1, L05425.1, U69600.1, AL034379.8, AB015478.1, X99436.1, AF076280.1, AC006920.10, AC004805.1,
AC007380.3, AF013149.1, AC007631.3, AF016485.1, AL137230.2, AL163241.2, AF016850.1, AL050403.13, Z50028.1,
S75106.1, AP001696.1, AP001596.1, AW409934.1, AW245855.1, AW161434.1, AW163245.1, AA858436.1,
AA316055.1, AA171883.1, AA308223.1, AW362598.1, AI112354.1, AI573674.1, AA690847.1, AW326870.1,
AA373618.1, AA352159.1, AUG77157.1, AA989948.1, AW250083.1, H35016.1, AA686046.1, AA684606.1,
AW245857.1, AW319272.1, AW765532.1, AV442312.1, AI994797.1, N38238.1, AW736578.1, AA068274.1,
AW174228.1, M908898.1, AI657589.1, AI657580.1, T80141.1, AW838515.1, AW838503.1, AW738493.1, AV107331.1,
AI482631.1, AA784611.1, AC023077.3, AC027731.2, AL355880.2, AC044835.2, AC040963.2, AC053546.3,
AC010634.4, AC015533.4, AC064107.1, AC067611.1, AC056245.1, AC033416.1, AC027813.1, AC018624.3,
AC025538.3, AC024646.2, AC024380.2, AL353692.3, AL138799.2, AL138841.1, AC027298.5, AC044833.2,
AC068953.1, AC023151.3, AC018669.3, AC022164.4, AC009026.5, AC023374.2, AC009768.4, AC027006.2,
AC026951.2, AC025065.2, AC009882.3, AC021409.3, AC011012.3, AC011693.4, AC018862.3, AC022052.2,
AC011860.3, AC016666.2, AC023958.2, AC010885.3, AC012206.3, AC013675.1, AC016064.1, AC009854.1,
AL158042.3, AL136537.3, AP001589.1, AP001568.1, AP001401.1, AP001392.1, AP001281.1, Z93240.1
SEQ ID NO: 377
ZH131/T3

NM_013285.1, L05425.1, U69600.1, AL034379.8, AB015478.1, X99436.1, AC024751.1, AC006920.10, AC004805.1,
Z68325.1, AP000067.1, AC007380.3, AF013149.1, AF016485.1, AL137230.2, AL163241.2, Z50028.1, Z97055.1,
Z82204.1, 575106.1, AP001696.1, AP001596.1, AK000019.1, AW245855.1, AW409934.1, AW161434.1, AW163245.1,
AA858436.1, AA316055.1, AA171883.1, AA690847.1, AA308223.1, AW362598.1, AI112354.1, AI573674.1,
AA373618.1, AW326870.1, AA352159.1, AA989948.1, AA684606.1, AU077157.1, AW250083.1, H35016.1,
AA686046.1, AL024316.1, AV125438.1, AW319272.1, AW245857.1, AW765532.1, H35824.1, AI853194.1, AA126101.1,
AV125326.1, AV442312.1, AI994797.1, N38238.1, T80141.1, AW736578.1, AW412154.1, AW377648.1, AW377646.1,
AA930842.1, AA866918.1, AA717513.1, AA671873.1, AA272186.1, AA239193.1, AA210106.1, AA116767.1,
AA068274.1, AA060411.1, AA020022.1, AW174228.1, AI908898.1, AI657589.1, AI657580.1, R23322.1, AW738493.1,
AV107331.1, AI661426.1, AI482631.1, AC023077.3, AC027731.2, AL355880.2, AC006721.1, AC040963.2, AC024442.3,
AC053546.3, AC064107.1, AC067611.1, AC056245.1, AC033416.1, A0027813.1, AC024380.2, AL353692.3,
AL138799.2, AL138841.1, AC013475.4, AC027298.5, AC044833.2, AC025258.4, AC023151.3, AC018669.3,
AC022164.4, AC009026.5, AC023374.2, AC026277.3, AC026276.2, AC009768.4, AC027006.2, AC026951.2,
ACJ025065.2, AC024191.3, AC02344&2, AC024531.2, AC011012.3, AC011693.4, AC018862.3, AC022052.2,
AC011860.3, AC016666.2, AC023958.2, AC021716.2, AC010734.3, AC013675.1, AC016064.1, AL354855.3,
AL136537.3, Z93240.1
SEQ IDNO: 378
ZH131/T7

NM_013285.1, L05425.1, AL034379.8, U69600.1, AE003547.1, D49682.1, AC007211.5, AC007020.4, AC006200.2,
AF085279.1, AL031635.1, AF235098.1, AE003829.1, AF125444.1, AL121748.6, AF016684.1, AL078468.1, Z72514.1,
AB021155.1, AFt 76688.1, AE003738.1, AC002454.1, AL049710.18, AL110509.2, AW157242.1, AA902387.1,
AI628921.1, AI925558.1, AA401208.1, AW070650.1, AW162279.1, AW409935.1, AA722289.1, AA126418.1,
AW172793.1, AA857353.1, AA780182.1, AW156969.1, AI376281.1, AW183614.1, AI826742.1, AA582490.1,
AI474094.1, AA446557.1, AA483614.1, AW246802.1, AA846248.1, AI253092.1, AA934590.1, AA888018.1,
AW804193.1, AI699045.1, AI867001.1, AA171554.1, AI954511.1, AI760439.1, AI763044.1, AI825244.1, AA126000.1,
AW768894.1, AI671605.1, AW804232.1, AI702310.1, W81287.1, AA493881.1, AA863491.1, AW804255.1, AA766044.1,
AA635139.1, AW804270.1, AA831455.1, AW118384.1, AA659293.1, AA196109.1, AI244063.1, AA659297.1,
M470650.1, AI798554.1, N32569.1, AA515590.1, AI245761.1, AW002316.1, AI909114.1, AW250835.1, AW362969.1,
AA524198.1, T27737.1, M345764.1, AW301566.1, AI310849.1, AI310651.1, AW268086.1, AI589981.1, AW268169.1,
AA056760.1, AW607751.1, AA614309.1, AW529039.1, AI112872.1, AI060050.1, AA546717.1, AW532741.1,
AW557260.1, AV220510.1, AI646349.1, AI536459.1, AI853259.1, AV090573.1, AI058723.1, AV310274.1, AW653179.1,
AV236721.1, AV236719.1, AV167761.1, AV328006.1, AW111676.1, AV153940.1, AA290477.1, AV311465.1,
AV296078.1, AV225966.1, AV136397.1, AV232948.1, AV121458.1, AC027731.2, AL355880.2, AC023077.3,
AC010058.5, AC013019.1, AC067926.1, AC068683.1, AC026348.2, AC022553.2, AC018707.5, AC023000.2, Z98865.1,
AC022165.3, AC022388.2, AC019056.4, AC016690.4, AC010732.3, AC015232.1, AC010859.2, AP001150.1,
AP000679.2, AC025097.8, AC062025.1, AC021296.2, AC024248.3, AF235096.1, AC009472.2, AC024127.1,
AC016670.3, AC019749.1, AC009454.1, AL136116.2, AL136090.9
SEQ ID NO: 379
ZH1371/T3

NM_013285.1, L05425.1, U69600.1, AL034379 8 NC_001146.1, Z71668.1, AF124045.1, AF124739.1, AF124737.1,
AC010150.3, AL355632.1, AP000386.1, D89267.1, AC006200.2, AC011664.8, AC009755.5, AF012277.1, U56240.1,
U40940.1, M32885.1, AA126544.1, AL135350.1, AA303227.1, AA403201.1, AA446682.1, W79685.1, AW246249.1,
AW577783.1, AA692026.1, AA475404.1, AA451012.1, AA126101.1, AI907635.1, AA058438.1, AA821350.1,
AI035443.1, AA581348.1, AW427911.1, AV138378.1, AW377646.1, AA271955.1, AW377648.1, W08841.1, AI763044.1,
AA794525.1, AA320025.1, AI943334.1, AL024316.1, AV399123.1, AI974265.1, AI157210.1, AA120514.1, AW755414.1,
AI166916.1, AW179912.1, AI181476.1, AV409400.1, AW649268.1, AW362969.1, AW093091.1, AI488290.1,
AW002316.1, M781856.1, AA373618.1, H35824.1, AW747374.1, AW146627.1, AW067567.1, AW054133.1,
AW017515.1, AI944299.1, AI184724.1, AA824259.1, AA399670.1, AC023077.3, AC027731.2, AL355880.2,
AC018362.3, AL354981.1, AC024581.2, AC022120.4, AC016650.4, AC013658.3, AC012448.3, AL161648.5,
AL139123.2, AC009780.4, AC067844.1, AC027070.2, AC040168.1, AC019089.3, AC021109.2, AC024063.1,
AC007495.3, AC023605.1, AL136959.2, AL138823.3, AL136104.3

TABLE 1-continued

Sequence homologies (GenBank Accession Numbers)

SEQ ID NO: 380
ZH205/T3

NM_013285.1, L05425.1, U69600.1, AL034379.8, AB015478.1, X99436.1, AC024751.1, AC006920.10, AC004805.1,
AC007380.3, AF013149.1, AF016485.1, AL137230.2, AL163241.2, Z50028.1, S75106.1, AP001696.1, AP001596.1,
AW245855.1, AW409934.1, AW161434.1, AW163245.1, AA858436.1, AA316055.1, AA171883.1, AW362598.1,
AA308223.1, M112354.1, AA690847.1, AI573674.1, AW326870.1, AA373618.1, AA352159.1, AU077157.1,
AA989948.1, AA684606.1, AW250083.1, K35016.1, AA686046.1, AW245857.1, AW319272.1, AW765532.1,
AL024316.1, AV125438.1, H35824.1, AV442312.1, AI994797.1, N38238.1, T80141.1, AW736578.1, AA068274.1,
AW174228.1, AI908898.1, AI657589.1, AI657580.1, AW745332.1, AW738493.1, AV107331.1, AI482631.1,
AC023077.3, AC027731.2, AL355880.2, AC006721.1, AC040963.2, AC053546.3, AC064107.1, AC067611.1,
AC056245.1, AC033416.1, AC027813.1, AC024380.2, AL353692.3, AL138799.2, AL138841.1, AC013475.4,
AC027298.5, AC044833.2, AC023151.3, AC018669.3, AC022164.4, AC009026.5, AC027595.2, AC023374.2,
AC026277.3, AC026276.2, AC009768.4, AC027006.2, AC026951.2, AC025065.2, AC011012.3, AC011693.4,
AC018862.3, AC022052.2, AC011860.3, AC016666.2, AC023958.2, AC010734.3, AC013675.1, AC016064.1,
AL136537.3, Z93240.1
SEQ ID NO: 381
Ubiquitin-Specific protease (UBP)

NM_003368.1, AP117386.1, AL117575.1, AB014458.1, AE003523.1, AF069441.1, AC006226.4, U14635.1, Z85995.1,
AB006700.1, AC006708.1, AE002611.1, AE001438.2, L29074.1, AL133238.2, AL121985.13, AL049839.3, AL050322.10,
AL109799.6, Z69730.1, AW340312.1, AI911716.1, AW749359.1, AW601534.1, AW340211.1, AW499935.1, AI335992.1,
H96555.1, AW304032.1, AA749334.1, AI478913.1, AA779218.1, AI656969.1, AA743294.1, AA577433.1, AA069285.1,
AA952959.1, AA016112.1, AA962284.1, AW089987.1, AA523181.1, AA723943.1, AA761280.1, AA019119.1,
AW822658.1, AA413779.1, T55607.1, AA832380.1, AW525342.1, AV123839.1, AW592620.1, AA281098.1,
AW182629.1, AA010709.1, AI071606.1, AI385272.1, AI008344.1, AI072340.1, AI001924.1, AA804171.1, AI716444.1,
AW771501.1, AA361227.1, AA099033.1, D61597.1, AV310156.1, T09031.1, AW858821.1, AA921156.1, AV315746.1,
AI050545.1, AA684326.1, AW663812.1, AA445060.1, AI040684.1, AI764163.1, T34154.1, AA389075.1, AA110253.1,
N50647.1, AW123867.1, AW121935.1, AI006640.1, AI006507.1, AA610647.1, AI815490.1, AV074783.1, C96400.1,
AA797782.1, AC025396.2, AL355389.1, AC011171.3, AP001167.1, AP000942.2, AC019070.2, AC027757.2,
AC025742.4, AC010054.4, AC009375.5, AC014849.1, AP001112.1
SEQ ID NO: 382
ZH053/T3

NM_003368.1, AP117386.1, AL117575.1, AB014458.1, AC003092.1, AC005488.2 NC_001138.1, AE003768.1,
AE003752.1, AE003699.1, AE001438.2, AC005589.1, AC006035.2, AC008148.2, AC004527.2, AC006112.2,
AC005146.1, AC004253.1, AL163204.2, AJ132695.4, AL009178.4, D50617.1, AL031119.1, AL035563.18, Z69730.1,
AL112201.1, AP001634.1, AB016897.1, J02714.1, M28060.1, D44599.1, AW601534.1, AW749359.1, AW499935.1,
AI335992.1, H96555.1, AW304032.1, AI911716.1, AA779218.1, AA577433.1, AA069285.1, AA952959.1, AW340312.1,
AW340211.1, AA749334.1, AA962284.1, AI656969.1, AA743294.1, AW089987.1, AA016112.1, AA523181.1,
AA761280.1, AA019119.1, AW822658.1, AA413779.1, T55607.1, AI478913.1, AW525342.1, AV123839.1,
AW592620.1, AA281098.1, AW182629.1, AI071606.1, AI385272.1, AI008344.1, AA723943.1, AA010709.1, AI072340.1,
AI001924.1, AA804171.1, AI716444.1, AA832380.1, AA361227.1, D61597.1, AV310156.1, AW858821.1, AV315746.1,
AI040684.1, AI764163.1, AA610647.1, AW820736.1, AV074783.1, AV298047.1, AV130736.1, AU074440.1,
AA299666.1, N57436.1, N55027.1, D80851.1, H83754.1, H49832.1, R43246.1, R42769.1, T46940.1, AC025396.2,
AL355389.1, AC019070.2, AC018465.3, AL355520.2, AP001112.1, AC025153.7, AC019059.3, AC027510.2,
AC005236.3, AC018437.2, AL133270.19, AL138915.3, AL137222.3, AC023799.9, AC025996.3, AC053543.3,
AC035142.2, AC010410.5, AC008899.4, AC024246.3, AC009412.3, AC055859.1, AC026145.2, AC026494.3,
AC035892.1, AC007334.3, AC022200.2, AC008284.5, AC007223.1, AC010394.2, AC009586.3, AC009881.3,
AC020681.2, AC007855.4, AC017235.1, AC017337.1, AC007753.3, AL356123.1, AL355863.2, AP001004.2, AP001207.1
SEQ ID NO: 383
ZH053/T7

NM_003368.1, AP117386.1, AL117575.1, AB014458.1, AL117503.1, X72910.1, AC026238.2, AE003461.1, AC004025.1,
NM_011365.1, AF132480.1, AF132479.1, AC005858.1, AP095792.1, AL078590.27, AL109628.2, AL117202.1,
AL021476.2, AC022521.4, NC_001136.2, AC009415.2, AC004160.1, NM_008031.1, AC010200.7, AC002492.1,
AF131838.1, AF126483.1, AP007544.1, U66059.1, AC004100.1, AC004223.1, AF009660.1, AF035298.1, L36190.1,
AL121576.Z Z46792.1, AL133243.1, AL021940.1, U63063.1, Z74201.1, X97751.1, U07975.1, Z57476.1, L23971.1,
AA628397.1, AA628438.1, AI743743.1, AI767389.1, AA741499.1, AA768854.1, AI677784.1, AI765361.1, AI511418.1,
AI627968.1, AA889584.1, AA015599.1, AI435166.1, AW188257.1, AW181895.1, AW015219.1, AI090415.1,
AI689149.1, AW301148.1, AI934936.1, AI000120.1, H81836.1, AA748367.1, AA804217.1, D79280.1, AI891100.1,
AA099034.1, AW016554.1, D62658.1, AA805297.1, AI698789.1, D79875.1, AA465112.1, AW770219.1, AI337477.1,
AW540444.1, AI848382.1, AW822264.1, AI681333.1, AW484136.1, AI186649.1, AI536041.1, AA395995.1, AI934237.1,
C85507.1, AW658316.1, D62657.1, AU016813.1, AA965253.1, AI010241.1, AU022718.1, AI467289.1, AU016862.1,
AI846844.1, I181837.1, AW681682.1, AW359811.1, AA839561.1, AA636424.1, AA472594.1, AA138196.1, AW486007.1,
AW321832.1, AA390042.1, AI030804.1, AV222579.1, AV276289.1, AV273007.1, AV016369.1, AV010041.1,
AV312954.1, AV309927.1, AV228458.1 AV266855.1, AV220500.1, AV273264.1, AV271972.1, AV254845.1,
AV240341.1, AV229917.1, AV254525.1, AV235477.1, AV275335.1, AV157245.1, AV268617.1, AV254319.1,
AV237589.1, AV220743.1, AV312158.1, AV240296.1, AV350107.1, AV305966.1, AV312731.1, AV276116.1,
AV271062.1, AV254741.1, AV247868.1, AV369945.1, AV030917.1, AV234637.1, AC025396.2, AL355389.1,
AC022415.4, AC012618.3, AC062036.1, AC034113.2, AC008110.2, AL353735.2, AL355599.2, AC012439.4,
AC019288.3, AC016766.3, AC020522.1, AL121952.6, AC055779.2, AC010404.3, AC010465.4, AC068504.1,
AC027716.2, AC022458.2, AC027000.2, AC025482.2, ACXL22931.3, AC015881.3, AL138836.3, AL162551.1

TABLE 1-continued

Sequence homologies (GenBank Accession Numbers)

SEQ ID NO: 384
ZH1313/T3

NM_003368.1, AF117386.1, AL117575.1, AB014458.1, AE003523.1, AF069441.1, AL161500.2, AL032655.1,
AL133421.1, Z85995.1, Z94721.1, AC006708.1, AE002611.1, AC008148.2, L29074.1, AC006060.1, AL133238.2,
AL133372.2, AL121985.13, AL050322.10, AI478913.1, AW340312.1, AW340211.1, AW771501.1, AA832380.1,
AA749334.1, AA743294.1, AI911716.1, AI656969.1, AA723943.1, AA099033.1, T09031.1, AA921156.1, AI050545.1,
AA684326.1, AW663812.1, AA445060.1, AA016112.1, AW749359.1, AA010709.1, AW601534.1, AI764163.1, T34154.1,
AA389075.1, AA110253.1, N50647.1, AW123867.1, AW121935.1, AI006640.1, AI006507.1, AI815490.1, AV074783.1,
C96400.1, AW605305.1, AW605290.1, AW485355.1, AV334525.1, AV316977.1, AV271577.1, AV271011.1, AI925190.1,
AI880405.1, AV089080.1, AU053253.1, AI601868.1, AI577543.1, AI568768.1, AI416338.1, AI354858.1, AI132532.1,
AA797782.1, AA789662.1, AA418927.1, AA242816.1, AA007209.1, N75527.1, N26669.1, H44548.1, T50640.1,
AC025396.2, AL355389.1, AC011171.3, AP001167.1, AP000942.2, AC027757.2, AC025742.4, AC010054.4,
AC009375.5, AC014849.1, AC022172.4, AC026984.1, AC006839.13, AL136322.2, AC026084.2, AC010594.4,
AC008504.4, AC027800.2, AC027392.2, AC021514.3, AC025821.2, AC009578.3, AC021258.3, AC018491.7,
AC012545.1, AL136442.10, AL139406.2

SEQ ID NO: 385
ZH1313/T7

NM_016520.1, AF218421.1, API51054.1, AL137549.1, AL008726.1, AL163249.2, AC010620.4, AC008044.4,
AC002377.1, AC004921.1, AC004383.1, AL163212.2, AL096801.18, Z96074.4, Z84483.1, AP001667.1, AP000962.2,
AC006055.1, AL163262.2, Z98036.1, AP001717.1, AP000191.1, AP000047.1, AP000115.1, AC006511.5, AC005089.2,
AC005145.1, AL022316.2, AC006344.2, AF001550.1, AL078463.1,1, AP000348.1, AC004024.1, AC004076.1,
AL135998.2, AL133448.3, AI003147.1, AC004000.1, AC004491.1, AC007308.13, AC006251.3, AL023553.5,
AP000509.1, AC010491.3, AC005086.2, AF139813.1, AC004228.2, AC005755.1, AL163953.2, U50871.1, AL121580.8,
AL033521.2, AC005231.2, AC004913.2, AC007360.2, AC007435.12, AF035396.1, AL121751.12, Z82215.1, AP000049.1,
AP000311.1, AC006464.3, AC006349.3, AC004850.2, AC006317.3, AC004997.2, AC007229.1, AC006958.1,
AC005562.1, AC005220.1, AL109627.18, AJ251973.1, AL008582.11, AL021453.1, Z92542.2, AL031311.1, AC018769.2,
AC004999.1, AC009405.3, AC002554.1, AC002558.1, AL161670.2, AL031296.1, AC008969.5, U96629.1, AL157915.2,
AC004150.8, AC005808.1, AL021393.1, Z82206.1, AP000555.1, AL132986.2, Z97630.11, AL096776.12, AP000212.1,
AP000134.1, AC004531.1, D83253.1, AP000009.2, AL031767.13, AI141544.1, AI651600.1, AI376077.1, AA503812.1,
AA516476.1, AI458346.1, AI052479.1, AI146331.1, AI695736.1, AI812016.1, AI863150.1, AI214622.1, AI002868.1,
AA639060.1, AI057130.1, AI913816.1, AI686336.1, AI685712.1, AI686315.1, AA503513.1, AA311466.1, AI765330.1,
M917006.1, AA934021.1, AW589928.1, AI763234.1, AW023167.1, AA761722.1, W80591.1, AA470915.1, AW088965.1,
AA579082.1, AA522864.1, AA156183.1, AA155817.1, W69639.1, N99245.1, AI459879.1, AW608403.1, AW162762.1,
F00937.1, AW392038.1, AA132445.1, AW795901.1, D44871.1, W78986.1, AI242236.1, AI520984.1, AW388476.1,
H89643.1, AW078646.1, AW072963.1, AI444575.1, M344906.1, M318548.1, AA505108.1, R87193.1, AW504667.1,
AI917132.1, AI523356.1, AA947352.1, AA489939.1, AI699746.1, AA015948.1, W60000.1, W03800.1, AW247866.1,
AI003391.1, AA663579.1, AL138226.1, AL044701.1, AW779609.1, AW131394.1, AW105463.1, AI918350.1,
AI754257.1, F35684.1, M631299.1, AI277617.1, AA664963.1, AA633804.1, AA595370.1, AA576672.1, 99365.1,
T52366.1, T40388.1, AW419288.1, AI702018.1, AA573335.1, AA526529.1, N72195.1, T71936.1, AI791664.1,
AI654336.1, AA348890.1, AI809776.1, AA287363.1, AA569648.1, AA230203.1, AA419403.1, AC027008.2, AL158207.3,
AC016109.3, AL138963.4, AC011638.3, AC021211.2, AC021055.6, AC012014.4, AC021026.3, AC018356.7,
AC011448.2, AC020561.2, AC023268.2, AP000761.1, AL109932.2, AC044812.2, AC011501.5, AC011495.3,
AC021420.3, AC019162.3, AC024944.2, AC026192.1, AC010130.4, AL353653.5, AL133230.19, AC022145.4,
AC017008.4, AL136135.2, AC023271.3, AC004085.1, AL354935.3, AC010247.6, AC021971.3, AC009008.2,
AL139398.2, AL139109.1, AC068707.2, AC035146.2, AC027342.2, AC008784.5, AC020931.3, AC025163.7,
AC008551.3, AC025370.2, AC021469.3, AC009996.3, AC023201.2, AL161787.4, AC008053.2, AC009863.2,
AC013421.5, AC009027.4, AC007256.2, AC055774.1, AC079912.4, AC024583.3, AC027474.2, AC024051.3,
AC022021.2, AC016124.2, AL138810.6, AL136097.10, AC0I3446.3, AC024582.3, AC025162.7, AC011498.4,
AC011480.2, AC024045.3, AC015945.3, AL161736.5, AL356140.1, AL355978.1, AL110504.2, AP000597.1,
AC020558.3, AC021187.4, AC008032.12, AC019131.3, AL158156.3, AL136233.3, AL031711.23, AC027178.3,
AC010264.4, AC067910.1, AC027250.2, AC062024.1, AC016385.3, AC005995.2, AL159993.3, AL160171.2,
AP001084.2, AC022766.2, AC011511.4, AC011486.5, AC009127.5, AL121914.20, AL161778.2, AP001075.2,
AC007616.2, AC068603.1

SEQ ID NO: 386
ZH1373/T3

NM_003368.1, AP117386.1, AL117575.1, AB014458.1, AP069441.1, AL161500.2, AL032655.1, AF108240.2,
AF108239.2, AF108238.2, AF108332.1, AP108331.1, AP108330.1, AF108329.1, AP108328.1, AF108327.2, AF108326.2,
AF108325.1, AF108324.1, AF108323.1, AP108322.1, AP108321.1, AF108320.1, AP108319.2, AF108318.1, AF108317.1,
AF108316.1, AP108310.1, AF108309.2, AF108308.1, AF108303.2, AP108302.1, AF108299.2, AF108298.1, AF108295.1,
AF108294.1, AF108291.1, AF108290.2, AF108289.1, AP108285.2, AF108283.1, AF108279.1, AF108276.1, AF108275.1,
AF108271.1, AF108270.1, AF108266.1, AF108258.1, AP108256.1, AF108255.1, AP108251.1, AF108250.1, AF108249.2,
AF108245.1, AF108243.2, AF108242.1, AF108236.2, Z85995.1, AC006708.1, AE002611.1, AF005090.1, L29074.1,
AC007436.1, AL133238.2, AL050322.10, AL080318.1, X75560.1, AI478913.1, AW340312.1, AW340211.1,
AW771501.1, AA832380.1, AA749334.1, AA743294.1, AI911716.1, AI656969.1, AA723943.1, AA921156.1,
AA099033.1, AI050545.1, AA684326.1, AW663812.1, AA445060.1, T09031.1, AW749359.1, AA016112.1, AI764163.1,
AA010709.1, AW601534.1, AA389075.1, AA110253.1, N50647.1, AW295260.1, AI954652.1, C96400.1, AI203173.1,
AW485355.1, AV334525.1, AV316977.1, AV271577.1, AV271011.1, AI880405.1, AV089080.1, AU053253.1,
AI601868.1, AI577543.1, AI416338.1, AI416266.1, AI132532.1, AA242816.1, AA007209.1, N26669.1, H44548.1,
AC025396.2, AL355389.1, AC027757.2, AC025742.4, AC010054.4, AC009375.5, AC014849.1, AL022597.5,
AL022596.1, AC022172.4, AC023271.3, AC010189.3, AC006839.13, AL121935.15, AC010269.3, AC010594.4,
AC015549.4, AC027012.2, AC021514.3, AC009578.3, AC013697.3, AC021258.3, AL159984.3, AL136442.10,
AL139406.2

TABLE 1-continued

Sequence homologies (GenBank Accession Numbers)

SEQ ID NO: 387
Novel DNA Binding Protein/50N

AB028942.1, AL163262.2, AP001717.1, AP000190.1, AP000046.1, AP000303.1, AP000114.1, X63071.1, NM_003103.1, X63751.1, X63753.1, M36428.1, AF193607.1, AF193597.1, AF096370.1, U67523.1, AL161492.2, A0007444.1, AE003698.1, AC004922.2, U61957.2, AE000616.1, AL021069.1, X60091.1, AE003578.1, AC011594.8, AC010186.6, AF160183.1, AC006560.8, AC007486.1, U20864.1, AC004279.1, AC005360.1, AL161509.2, AL138664.1, Z81583.1, Z97183.1, Z99290.1, AL078630.1, Z83087.1, AW500791.1, AI093497.1, AA664291.1, AA789090.1, AW173628.1, AI858858.1, AW440738.1, AI656181.1, AW162728.1, AW168833.1, AA115678.1, AW079444.1, AA627614.1, AW025637.1, AW502403.1, AI702294.1, AA172113.1, AI801337.1, AA092460.1, AL046209.2, AA036700.1, W79819.1, AW073811.1, AI610270.1, AA063617.1, AA155757.1, AA56821.1,1, AI905785.1, AI905720.1, AI854469.1, AI585864.1, AA647960.1, C76879.1, AA779531.1, AI561366.1, AA880031.1, AI874007.1, AW209037.1, AA654021.1, W02066.1, N25237.1, AW709451.1, AW382784.1, AW255430.1, AU074816.1, AU038934.1, C96900.1, T24344.1, T24239.1, AC023286.1, AC025147.2, AC026052.2, AC009337.1, AC012151.5, AC021710.4, AC020159.1, AC009393.3, AL109926.2, AL159988.4

SEQ ID NO: 388
ZH122/T3

AB028942.1, AL163262.2, AP001717.1, AP000190.1, AP000046.1, AP000303.1, AP000114.1, X63071.1, NM_003103.1, X63751.1, X63753.1, M36428.1, AF193607.1, AF193597.1, U67523.1, AC007444.1, AE003698.1, AC004922.2, U61957.2, AE000616.1, AL021069.1, X60091.1, AE003578.1, AC006560.8, AC007486.1, U20864.1, AC004279.1, AL138664.1, Z81583.1, Z97183.1, AL078630.1, AW500791.1, AI093497.1, AA664291.1, AA789090.1, AW173628.1, AI858858.1, AW440738.1, AI656181.1, AW162728.1, AW168833.1, AA115678.1, AW079444.1, AA627614.1, AW025637.1, AW502403.1, AI702294.1, AA172113.1, AI801337.1, AA092460.1, AL046209.2, AA036700.1, W79819.1, AW073811.1, AI610270.1, AA063617.1, AA155757.1, AA568211.1, AI854469.1, AI585864.1, AA647960.1, C76879.1, AA779531.1, AI561366.1, AI874007.1, AA880031.1, AW209037.1, AA654021.1, W02066.1, N25237.1, AW709451.1, AW255430.1, AU074816.1, AU038934.1, L24344.1, L24239.1, AC023286.1, AC020159.1, AC009393.3, AL109926.2, AL159988.4, AC006431.8, AC037431.3, AC068960.1, AC016481.4, AC020783.5, AC034225.3, AC022128.4, AC022101.3, AC022091.3, AC010309.4, AC008790.4, AC008453.4, AC032028.2, AC022032.2, AC034209.1, AC025961.2, AC025589.6, AC011804.2, AC022731.2, AC005506.6, AC011799.5, AC022673.3, AC018535.3, AC023630.3, AC012584.5, AC022404.4, AC018388.4, AC012283.2, AC006513.24, AC020062.1, AC021612.1, AC015716.2, AL109933.20, AL136179.10, AL117346.16, AP002077.1, AP001899.1, AP001891.1, Z93340.1, Z92853.1

SEQ ID NO; 389
ZH122/17

AL163262.2, AP001717.1, AP000191.1, AP000046.1, AP000304.1, AP000115.1, NM_003103.1, X63753.1, X63071.1, X71604.1, X63754.1, S79056.1, AF193606.1, 579073.1, S79065.1, S79173.1, S79122.1, S79121.1, AC009948.3, AE003585.1, AE003488.1, AC004991.1, AF060492.2, AC003945.1, AL163229.2, AL049833.3, Z75741.1, AP001684.1, AP000953.2, AP000399.1, AC006931.5, AF130357.1, AC004843.1, AC006036.3, AF139813.1, AC004228.2, AC005755.1, AF086106.1, AC003025.1, AF053468.1, AL161545.2, AL032632.1, AL021331.1, Z97343.1, Z97342.2, AJ131244.1, AP000364.1, U12660.1, AB020742.1, M57403.1, AI127294.1, AW183190.1, AW057768.1, AI986205.1, AI632353.1, AI829400.1, AW009915.1, AA004621.1, AI689364.1, AI023134.1, AA993267.1, W93400.1, AW071490.1, AI018093.1, AW166988.1, AW628118.1, AI143809.1, N533 53.1, AI266546.1, AA857332.1, AI223425.1, AA772726.1, AI719242.1, W72973.1, AW304836.1, AW243063.1, AA135743.1, AI768842.1, AA872747.1, AI149578.1, AI038972.1, AI371983.1, AI200398.1, AI658892.1, AI572963.1, AI079652.1, AI183623.1, AA772215.1, AI034430.1, AI471859.1, AI148234.1, AI091926.1, AW081281.1, AI707914.1, AA431849.1, AA257112.1, AI358802.1, AI161381.1, AI270200.1, AA694295.1, AW001009.1, AA679405.1, AA837277.1, N70647.1, AA693673.1, AA133200.1, AA032186.1, AI051633.1, D20101.1, AA992481.1, AW089317.1, N24069.1, AI087419.1, AA707015.1, AA844291.1, W02725.1, F03502.1, AA225330.1, AI300124.1, L24029.1, W19535.1, K10383.1, AI471076.1, AA225331.1, N50988.1, H99525.1, AA852180.1, AA580105.1, N44831.1, AI369509.1, AI300125.1, D56905.1, AA771805.1, AA011291.1, AI445493.1, AI044112.1, H53644.1, AI411504.1, R42100.1, AW148843.1, R41991.1, W27063.1, AA890446.1, AL040534.1, AI018814.1, AA278461.1, AW520510.1, AI461608.1, AI426368.1, AW543039.1, AC015861.5, AC023312.2, AC009883.3, AC015624.2, AC060792.2, AC061971.2, AC025469.3, AC020914.6, AC008750.6, AC011490.4, AC010973.3, AC026497.1, AC011068.7, AC023217.2, AC020488.1, AC017153.1, AC015894.2, AL135793.5, AC068802.3, AC063957.6, AC010636.5, AC008554.6, AC063950.2, AC010301.4, AC051664.2, AC013455.3, AC010095.3, AC048365.1, AC021218.3, AC025473.2, AC021965.3, AC019311.4, AC011954.5, AC012400.4, AC010754.2, AC018955.2, AC022636.3, AC018584.3, AC024480.2, AC024387.2, AC010910.6, AC018377.4, AC023989.2, AC011025.4, AL136384.3, AL353153.2, AL138724.2, AL139319.4, AL354869.1, AP001947.1, AP001823.1, AP001199.1, AP001164.1, AP000766.1

SEQ ID NO: 390
ZH1387/T3

AL163262.2, AP001717.1, AP000190.1, AP000046.1, AP000303.1, AP000114.1, X63071.1, AB028942.1, NM_003103.1, X63751.1, X63753.1, AF193607.1, AF193597.1, AF096370.1, AL161492.2, AC007444.1, AE003698.1, X60091.1, AC011594.8, AC004988.2, AC010186.6, AF160183.1, AC005360.1, AL161509.2, Z81555.1, Z97183.1, Z99290.1, Z83087.1, AW500791.1, AI093497.1, AA664291.1, AA789090.1, AI905785.1, AI905720.1, AW173628.1, AW440738.1, AI858858.1, AW162728.1, AA880031.1, AA036700.1, AI656181.1, AI585864.1, AW168833.1, AA115678.1, AI854469.1, AA627614.1, AL046209.2, N25237.1, AW382784.1, AW255430.1, AI645064.1, C96900.1, W79819.1, AC023286.1, AC009771.4, AC025147.2, AC026052.2, AC009337.1, AC012151.5, AC021710.4, AC020159.1, AC009393.3, AC010854.3, AC020783.5, AC034225.3, AC027332.2, AC022128.4, AC022101.3, AC008639.6, AC008790.4, AC032028.2, AC024035.3, AC022032.2, AC034239.1, AC032032.1, AC015514.3, AC025788.2, AC012269.2, AC022731.2, AC025142.2, AC022810.3, AC020776.3, AC016378.4, AC012587.4, AC011799.5, AC021009.3, AC021065.3, AC024007.2, AC012584.5, AC006513.24, AC022814.2, AC021921.1, AC021612.1, AC015716.2, AC012430.2, AC011968.1, AL136999.17, AL355612.2, AL355350.1, AL136179.10, AL138849.5, AL117346.16, AP002077.1, AP001891.1, AL049185.4, AP001087.2, AP001275.1, AP001272.1, AP001176.1

TABLE 1-continued

Sequence homologies (GenBank Accession Numbers)

SEQ ID NO: 391
ZH1387/T7

AL163262.2, AP001717.1, AP000191.1, AP000046.1, AP000304.1, AP000115.1, NM_003103.1, X63753.1, X63071.1,
X71604.1, X63754.1, AF193606.1, S79056.1, S79065.1, S79073.1, S79173.1, AC006036.3, AC005755.1, AJ131244.1,
AW304836.1, AW166988.1, AI719242.1, AI127294.1, AI038972.1, AW183190.1, AI658892.1, AI371983.1, AI632353.1,.
AI270200.1, AI091926.1, AA772215.1, AA431849.1, AW081281.1, AI829400.1, AW057768.1, AI572963.1, AA032186.1,
AW009915.1, A.1986205.1, AI087419.1, AA133200.1, AA225330.1, AI689364.1, AI300124.1, AI023134.1, AA993267.1,
W19535.1, AI300125.1, AA852180.1, AA004621.1, AA844291.1, T24029.1, AA857332.1, N44831.1, AW071490.1,
AI018093.1, W72973.1, AA771805.1, M143809.1, AW628118.1, AA872747.1, AA225331.1, N50988.1, AI768842.1,
AI266546.1, AA772726.1, W93400.1, AW243063.1, AI223425.1, AI149578.1, AI034430.1, AA135743.1, AI200398.1,
N53353.1, M183623.1, AI707914.1, M369509.1, AI079652.1, H53644.1, AI471859.1, AA257112.1, AI148234.1,
N70647.1, AI358802.1, AI161381.1, AA693673.1, W27063.1, AA837277.1, AA694295.1, AA679405.1, AW001009.1,
AI051633.1, AL040534.1, R42100.1, D20101.1, AA992481.1, D56905.1, AA278461.1, R41991.1, AW089317.1,
AW148843.1, W76210.1, N24069.1, AA707015.1, F03502.1, AW024013.1, W02725.1, AU059172.1, AW520510.1,
AI044112.1, AI471076.1, AA580105.1, H10383.1, AW838467.1, AI411504.1, H99525.1, AA011291.1, AA914126.1,
AA763747.1, AC026497.1, AC010301.4, AC024387.2, AL353760.2, AL139410.2

SEQ ID NO: 392
Carboxyterminus HSP70 (CHIP)

AF129085.1, NM_005861.1, AF039689.1, Z92544.1, AF129086.1, Z46940.1, NM_015185.1, AE003761.1, AF003630.1,
AF003629.1, U85251.1, U85040.1, U85039.1, AB007884.1, AC016951.9, NM_006114.1, NM_006326.1, AC007406.1,
M60319.2, AF050154.1, AF043251.1, AF043250.1, AC005296.1, AC005696.1, AL050075.1, AL021391.2, AJ011716.1,
AL021899.1, L19655.1, M93129.1, Y18007.1, M73822.1, M62862.1, NM_013379.1, NM_015456.1, AC007968.3,
AE003655.1, AE003552.1, AE003445.1, NM_011258.1, NM_006081.1 NM_004608.1, AF154502.1, AF038163.1,
AF091504.1, AF030050.1, U07157.1, AF059678.1, AC003663.1, AJ002220.1, U 15037.1, AL050280.1, AL137480.1,
AL031595.4, AL034379.8, Z98742.5, X06542.1, U53344.1, AJ007989.1, M88489.1, U36441.1, X72711.1, D17315.1,
M73980.1, X75917.1, Z63970.1, AB002354.2, J05475.1, Z58600.1, Z64961.1, Z57538.1, AB023231.1, X56659.1,
D78638.1, L10425.1, U01222.1, AI630895.1, AI971879.1, AW074238.1, AA573790.1, AI097431.1, AI732281.1,
AA775749.1, AI133167.1, AI476536.1, AW272212.1, AL313142.1, AW074246.1, AA523100.1, AI922522.1, AA977131.1,
AI567504.1, AI800972.1, AW519276.1, AW007382.1, AI265896.1, AA707243.1, AI186162.1, AA156751.1, AA872941.1,
AA988951.1, AW780114.1, AA196335.1, AA777058.1, AI040100.1, AI095230.1, AI193384.1, AI884857.1, AI147782.1,
AI084116.1, AI186356.1, AA156923.1, AI263601.1, AA916340.1, AA126861.1, AA114904.1, AA113285.1, AI367545.1,
AI248132.1, AI350140.1, AI265894.1, AA113175.1, AW392245.1, AW134969.1, AI241250.1, AI829488.1, AW769510.1,
AW800139.1, AL045313.1, AA604290.1, H46715.1, R44011.1, T35752.1, AA081740.1, AA975174.1, AI801581.1,
AA913651.1, AA100870.1, N44930.1, AW410549.1, AA358373.1, AI857353.1, F37468.1, N48716.1, AA114903.1,
T31912.1, AA127292.1, AI820702.1, W19324.1, AI954554.1, AW602696.1, AW229260.1, AA431375.1, P36498.1,
AA195861.1, H46168.1, AI930417.1, AI250171.1, AI799945.1, P31326.1, AI270045.1, R73332.1, I146782.1, AI971264.1,
AW083927.1, R40538.1, AA034510.1, AA377856.1, AI670750.1, AA369419.1, R54831.1, N45564.1, T03682.1,
R46339.1, AA838975.1, AA161201.1, AC068332.1, AC016209.3, AC007818.6, AC023027.1, AC012366.3, AC013071.1,
AL355142.1, AC021051.3, AC011847.3, AC011088.8, AC011556.5, AC011531.6, AC011481.2, AC022266.3,
AC020772.3, AC009433.2, AC012122.2, AC021988.3, AC021830.5, AC018775.3, AC022408.3, AC021753.3,
AC016796.2, AC016741.2, AC024694.1, AC021051.2, AC022155.1, AC012116.1, AP000795.1

SEQ ID NO: 393
ZH037/T3

NM_016195.1, AL137392.1, AL117496.1, U67547.1, U07563.1, AL139077.2, A3012549.1, AI012548.1, AJ131631.1,
AJ131605.1, AJ131604.1, AJ006413.1, AC005517.6, AC007538.5, AL161580.2, AL161553.2, Z81308.2, U80842.1,
AL080253.2, Z35983.1, Z35981.1, X78993.1, X66247.1, M86929.1, M23440.1, AE003619.1, AC005826.1, AE003777.1,
AC003078.1, AF080676.2, AF121877.1, U14635.1, AL033514.1, AI207433.1, AW087682.1, N27428.1, N91105.1,
AW073910.1, N63752.1, AW804880.1, AV167631.1, AI050668.1, AU043551.1, AU043451.1, AW575801.1,
AW332046.1, AW186938.1, AI943584.1, AI556638.1, AA598340.1, AW826622.1, AW642869.1, AW429262.1,
AW429260.1, AW264218.1, AW264313.1, AV267378.1, AV266927.1, AV261836.1, AV383573.1, AW077965.1,
AW059145.1, AW050948.1, AW002731.1, AI991076.1, AI959674.1, AI895859.1, AI884592.1, AI865631.1, AI864349.1,
AI851787.1, AI830437.1, AI830001.1, AI826534.1, AI806788.1, AI796066.1, AI769520.1, AI764991.1, AI739031.1,
AI694336.1, AI688370.1, AI659991.1, AI636072.1, AI523645.1, AI446795.1, AI376598.1, AI168732.1, AI151708.1,
AI123957.1, AI092234.1, AI060045.1, AA981087.1, AA835447.1, AA805323.1, AA767572.1, AA736849.1, AA622266.1,
AA477542.1, AA460997.1, AA453387.1, AA434777.1, AA260524.1, AA253431.1, AA211867.1, AA209000.1,
AA154452.1, AA142890.1, AA059694.1, AA050064.1, N31935.1, N20982.1, H27300.1, R77327.1, R48581.1, R28039.1,
AL157389.3, AL161733.3, AL353776.3, AC064835.3, AC007569.7, AC022888.2, AC015047.1, AL355489.4,
AL354658.2, AP001567.1, Z98856.1, AC018441.3, AC027476.2, AC027123.3, AC009590.4, AC021314.3, AC008221.3,
AC008347.1, AL163545.4, AL163541.5, AL022287.1

SEQ ID NO: 394
ZH037/T7

AL137392.1, NM_016195.1, AL117496.1, U93121.1, AL132715.2, AF123535.1, AF025309.2, AF049111.1, AF074609.1,
AF074608.1, AF074607.1, AF025308.1, AI277139.1, M64795.1, X82669.1, NC_001134.1, AC010582.6, U34732.1,
U56248.1, Z35775.1, L33863.1, X77199.1, AE003812.1, AE003781.1, AC005359.1, Z36753.1, AA206237.1,
AA402625.1, AI640101.1, AA166435.1, M449051.1, AW641069.1, AV229003.1, AW637360.1, AW636913.1,
AW104978.1, AI873411.1, AI744621.1, C82336.1, AI493892.1, AI468801.1, AA944214.1, AA814955.1, AA742281.1,
AA477401.1, AA479561.1, AA437337.1, H61147.1, H18470.1, I90042.1, AL157389.3, AC031975.3, AC027641.1,
AC022008.2, AC016018.7, AC019190.2, AC010975.3, AC069156.1, AC068918.2, AC026074.4, AC022269.3,
AL3 55997.1

TABLE 1-continued

Sequence homologies (GenBank Accession Numbers)

SEQ ID NO: 395
ZH054/T3

AF161348.1, AC006568.7, AE000692.1, AE003650.1, AE003415.1, AL078603.4, NC_001137.2, AC006020.2,
AC005940.3, AC006924.3, AC006258.1, AF054502.1, AF051344.1, U18779.1, AD000092.1, AL031289.1, AL034426.4,
AL021917.1, M69188.1, AI948670.1, AI478382.1, AW160598.1, AW658028.1, AW793862.1, AA421360.1, AW326431.1,
AA774426.1, AW165025.1, AI959670.1, AI496955.1, AW777910.1, AW281091.1, AV224187.1, AI167050.1,
AA741176.1, AA148784.1, I98755.1, AL355978.1, AC024509.2, AC019070.2, AC067740.2, AC055809.2, AC024705.4,
AC063848.1, AC021360.3, AC021038.3, AC009965.4, AC017767.1, AC011049.3, AC026633.3, AC053511.2,
AC020934.6, AC024190.2, AC027759.2, AC026561.2, AC023862.2, AC011189.4, AC011058.3, AC009792.4,
AC020642.3, AC024480.2, AC011566.3, AC025598.1, AC021535.2, AC023917.2, AC023847.2, AC013374.4,
AC022888.2, AC012106.2, AC009483.2, AF178220.1, AL121936.9, AL354812.5, AU61720.3, AL133338.3,
AL356122.1, AL355983.1, AL157413.6, AL355379.1, AL354914.1, AL031669.27, AL353614.1, AL157775.3,
AL139353.1
SEQ ID NO: 396
ZH054/T7

AF039690.1, U79271.1, AL117525.1, AF136378.1, AL031650.21, AC006919.5, AC006607.1, AE003496.1,
NM_012776.1, AC008056.6, NM_0016192 AC007538.5, S81843.1, S48813.1, U08438.1, Z22173.1, Z68282.1,
ALL21757.7, AL049544.4, AL031681.13, U39674.1, L23127.1, M34073.1, M80776.1, X61157.1, M74822.1, M87854.1,
X53421.1, AI735499.1, AW028371.1, AI445418.1, AI266387.1, AI288955.1, AW193663.1, AI298467.1, AI168222.1,
AI148323.1, AI140814.1, AI089322.1, AA879456.1, AA843811.1, AA829894.1, AA102109.1, AA029201.1, W72147.1,
N51485.1, AI808317.1, AI033069.1, AA161465.1, AA812519.1, N64528.1, I199906.1, AA886109.1, R71679.1,
AI970343.1, AA744290.1, AW021346.1, AA099913.1, AW195719.1, AI267979.1, AA083859.1, AI038590.1, N51277.1,
AA883684.1, R07471.1, H98684.1, R36854.1, R39448.1, P25334.1, AA083954.1, R54092.1, I109074.1, AA346369.1,
AA910762.1, N21975.1, D59844.1, AW195087.1, H11525.1, AA971254.1, W77907.1, AW057648.1, AL041060.1,
AI659852.1, AA878973.1, AW392482.1, AI057361.1, AA715235.1, P35739.1, W29097.1, AW022199.1, AA860455.1,
AI963422.1, AA026096.1, AW427844.1, AI481147.1, L26899.1, AW413553.1, AW046739.1, AI529534.1, AI661769.1,
AA269966.1, N71178.1, AI614472.1, AI713205.1, AI575014.1, AI112396.1, AI073194.1, AA026516.1, AI651890.1,
AI575171.1, AA466212.1, AV162955.1, AW495689.1, AI397450.1, AW547034.1, AW502609.1, AW479264.1,
AI685864.1, AI652378.1, AA985290.1, AA161236.1, AC022960.2, AP001333.1, AC018648.2, AC068004.1, AC013699.2,
AC021912.3, AC018685.5, AC016418.4, AF202962.1, AL139349.15, AL132661.15, AL117190.2, AC036143.2,
AC010798.6, AC026746.3, AC016645.3, AC034117.2, AC018640.1, AC009244.20, AC068501.1, AC009444.2,
AC026950.2, AC021551.4, AC021417.3, AC026750.2, AC020854.2, AC019240.4, AC025291.5, AC009577.3,
AC026809.1, AC022882.3, AC016884.4, AC016721.4, AC016695.4, AC023002.1, AC024342.2, AC022528.2,
AC012768.1, AC015865.1, AC011290.2, AL157902.2, AL353720.2, AL355481.1, AL158068.4, AL162632.1,
AL159973.2, AL133501.1, AL137007.4, AP001932.1, AP001586.1, AP001203.1, AP001023.1, AP000425.1
SEQ ID NO: 397
ZH115/T3

U00951.1, NM_011767.1, AF071059.1, U00960.1, NM_016107.1, AF100742.1, AL020996.5, AC004226.1, AL020990.1,
AI131040.1, M74208.1, AC006418.3, U88173.1, AL096773.6, AC009046.4, AF007276.1, AF235093.1, AE003528.1,
AC004458.1, AC005234.1, AC002301.1, AC005158.2, AF109780.1, AC005394.1, AC005355.1, AF001905.1,
AC004386.1, AC002418.1, AL163211.2, AL109762.3, Z77134.1, AL035427.17, AL023775.1, Z83843.1, AL110503.1,
AP001666.1, AB004829.1, Z11876.1, AP001344.1, Z12134.1, AK000899.1, AP000494.1, M94863.1, X53926.1,
M459274.1, AA884767.1, AW104349.1, AA233365.1, N92665.1, AI870590.1, AI568546.1, N58504.1, AA601060.1,
AA282826.1, AL120871.1, AA807029.1, AA232979.1, AI198040.1, AW407987.1, AL162096.1, AC043006.1,
AW439732.1, AA807087.1, AA969488.1, AA121004.1, N99611.1, AA649579.1, AA344680.1, AA558006.1, W26569.1,
AW753743.1, AW281117.1, AW762096.1, AW858925.1, AW625753.1, AW624533.1, AW455258.1, AJ280548.1,
AW219596.1, AW091636.1, AW018668.1, AI782083.1, AI774604.1, AA670786.1, AA004472.1, D67255.1, AW663818.1,
AW625553.1, AW564331.1, AW388055.1, AV347281.1, AI791561.1, AI727561.1, AA903175.1, AA812908.1,
AA810192.1, AA806811.1, AA477517.1, AA430246.1, AA191601.1, W32817.1, N44994.1, N27997.1, H44157.1,
H42666.1, H26899.1, H26712.1, H20671.1, H19589.1, H10454.1, R79673.1, R65622.1, R34200.1, T94610.1, T85643.1,
AC008949.5, AC016183.1, AC013605.1, AC048373.2, AC023060.3, AC010310.3, AC010607.4, AC009541.14,
AC053536.2, AC025410.2, AL159170.3, AL109855.12, AC015536.3, AC025281.2, AC009683.3, AC019355.3,
AC115793.2, AC016361.1, AP001404.1, AC012486.3, AC041020.2, AC058823.2, AC032018.2, AC068656.1,
AC025767.3, AC012615.3, AC011405.4, AC044791.3, AC025763.2, AC024085.2, AC018664.7, AC018641.1,
AC010533.3, AC010528.4, AC016284.4, AC023334.3, AC026611.2, AC026592.2, AC026565.2, AC026955.2,
AC021836.3, AC022980.2, AC010960.3, AC011901.2, AC023590.2, AC010066.5, AC013265.4, AC012448.3,
AC016978.2, AC021826.1, AC014423.1, AC013742.1, AC011296.1, AC006594.1, AL355853.2, AL138891.5,
AL354655.3, AL161421.3, AL136104.3, AP001861.1
SEQ ID NO: 398
ZH115/T7

NM_016107.1, AF100742.1, AL137258.1, AE003787.1, AE003517.1, AE003467.1, AE002994.1, AC012328.4,
AL163239.2, U56966.1, AP000140.1, AP000228.1, AP000088.1, AC008277.3, AE003688.1, AC005365.1, AF064866.1,
AC004052.1, AL160413.6, AL161581.2, AL080317.11, Z84468.1, AL031589.10, AB040937.1, AL034567.1, AP000962.2,
AW003071.1, M697949.1, AA044907.1, AI459130.1, M457645.1, AW043719.1, AI653343.1, AI215588.1, AI823552.1,
AW169303.1, M239441.1, AI355964.1, M032008.1, AW193966.1, AI494082.1, AA977494.1, AA833810.1, AA452846.1,
AI922576.1, AI678750.1, AI522326.1, AI129323.1, AW009898.1, AI417741.1, AW512987.1, AA960990.1, AA459953.1,
AW513344.1, AA133606.1, AA452986.1, AA133980.1, AW009457.1, AA126775.1, AA928638.1, AA922732.1,
AA182611.1, AA767799.1, N23288.1, R85777.1, AW292228.1, AI554259.1, AA652535.1, AI192659.1, AI590928.1,
AA065256.1, H61311.1, AW439475.1, AI219694.1, AI500438.1, AI431251.1, AI378745.1, H21148.1, D20112.1,
AI270743.1, H85185.1, T57220.1, AA506082.1, AI880772.1, AW194028.1, AA181633.1, Z19460.1, H88299.1, T55419.1,
R34592.1, AW518550.1, AA046500.1, AW816525.1, T30297.1, AA450197.1, AW143843.1, AA045458.1, AW104897.1,
AA838848.1, AA163538.1, AA163136.1, AI230546.1, R69726.1, AA435277.1, AA825536.1, AA185159.1, AI235292.1,
AI228295.1, AI702737.1, AI171031.1, AA447301.1, AA963808.1, AW107691.1, N56482.1, AW822973.1, AW555757.1,

TABLE 1-continued

Sequence homologies (GenBank Accession Numbers)

AI630711.1, AU019152.1, AA546061.1, AL118289.1, AA388699.1, AV327645.1, AV210720.1, AV111836.1,
AV331842.1, AV366554.1, AC008949.5, AC011655.4, AC024292.2, AL133406.4, AC032019.2, AC014667.1,
AC018657.8, AC011029.3, AC011266.3, AC006169.5, AC009378.5, AC017833.1, AC017293.1, AC015864.1,
AC015087.1, AP001162.1, AC068645.2, AC009719.2, AC055730.1, AC018451.6, AC068474.1, AC024063.1,
AC010899.3, AC012265.1, AL109912.5, AL162733.2
SEQ ID NO: 399
ZH1254/T3

AP000354.1, AC000095.3, X91348.1, AB002374.1, AC007744.2, AC005579.1, AC005265.1, Z83839.1, U16027.1,
NC_001136.2, AE003756.1, AC012188.2, NM_012504.1, AF115393.1, AF124366.1, AF124365.1, AC004527.2,
AC004050.1, U97009.1, AC004638.1, AL163204.2, AF022980.1, AL157475.1, AL031670.6, AL032643.1, AP001634.1,
Z68194.1, X05882.1, D10359.1, U20499.1, L24160.1, M28647.1, M14511.1, Z99120.1, AL041214.1, AI479306.1,
T19286.1, AV077676.1, AW610362.1, AA469910.1, AW851333.1, AW851196.1, AW761950.1, AW475612.1,
AW258171.1, AW230431.1, AW161704.1, AW006996.1, AW006763.1, AI952960.1, AI786648.1, AI608836.1,
AI583717.1, AI378941.1, AI227130.1, AI225655.1, AI197153.1, AI157833.1, AI119403.1, AI077445.1, AI034178.1,
AA973649.1, AA919330.1, C83508.1, C82652.1, AA882029.1, AA871165.1, AA727880.1, AA626956.1, AA626943.1,
Z99358.1, AA563109.1, AA510094.1, AA500957.1, AA494301.1, AA462637.1, AA462634.1, AA446699.1, AA446572.1,
AA433925.1, AA286171.1, AA268339.1, AA238626.1, AA237522.1, AA268467.1, AA165429.1, AA105246.1,
AA105755.1, AA058303.1, AA014372.1, AA014032.1, W80249.1, W54133.1, W12919.1, N54195.1, N34293.1, R95811.1,
H34521.1, T96924.1, AC011896.3, AC068808.4, AC010232.4, AF252831.1, AF252830.1, AC034154.1, AC021680.3,
AC023929.2, AL157375.1, AC069072.1, AC063926.2, AC011830.3, AC026399.3, AC010480.4, AC020581.6,
AC009329.18, AC012645.4, AC027414.2, AC067837.1, AC011819.2, AC044802.1, AC026881.3, AF235100.1,
AC021802.3, AC027352.1, AC026397.2, AC015991.3, AC026086.2, AC024154.1, AC016724.4, AC020616.3,
AC022206.2, AC025266.1, AC018502.4, AC018499.2, AC011143.3, AC024260.1, AC008214.3, AC013296.4,
AC012994.1, AC011832.2, AL139331.4, AL355995.1, AL355800.2, AL353581.3, AL138816.5, AL138916.5,
AL161419.5, AL162502.2, AL118558.1, AL022594.18, AP001919.1, AP001593.1, AP001487.1, AP000872.2,
AP001133.1, Z92862.1
SEQ ID NO: 400
ZH1263/T3

AK000867.1, AC005632.2, AC009313.4, AC006761.1, NC_001135.1, AF063023.1, AF003135.1, U41279.1, AL023655.1,
X78964.1, X59720.1, AC004077.2, AE003593.1, Z83232.1, Z81042.1, Z95126.1, AL109799.6, AL049658.1, M27965.1,
NC_001136.2, AC008169.2, AC009303.2, AE003538.1, AC004846.2, AC004000.1 NM_001273.1, AC004936.2,
AC006016.2, AC004513.1, L63545.1, AC006064.9, AC004044.1, U96409.1, AC005859.1, AF069442.1, AC002406.1,
AL138640.1, AL161495.2, Z75542.1, Z84468.1, AL110295.2, L78810.1, Z97195.1, L34213.1, M87378.1, X91498.1,
Z74106.1, Z74105.1, X54378.1, AB002314.2, AB024032.1, X93497.1, X86691.1, M97259.1, AA139239.1, AW320448.1,
AA066190.1, AA133526.1, AW205376.1, AW541589.1, AA574532.1, AV155978.1, AW837822.1, AW188258.1,
AA963562.1, AW594341.1, AA088126.1, AI876844.1, AI529340.1, AA157075.1, AI027222.1, AW779632.1, Ar820911.1,
AA293753.1, AV199216.1, AV185506.1, AV185316.1, AV185007.1, AV184384.1, AV176628.1, C60137.1, C54010.1,
C52297.1, C52274.1, C38524.1, C30959.1, C30741.1, C30240.1, C11568.1, D65188.1, D71090.1, AI998612.1,
AI903395.1, AI163787.1, T46763.1, T14163.1, AA040957.1, AA389793.1, U74171.1, N37898.1, R89930.1, T43416.1,
AV416695.1, AW743519.1, AW503576.1, AW479966.1, AW261224.1, AW256152.1, AU079141.1, AW065755.1,
AW047625.1, AW040511.1, AW037723.1, AW036849.1, AW047630.1, AI929739.1, AI892446.1,
AI841037.1, AI837262.1, AI837252.1, AI833887.1, AJ820275.1, AI820169.1, AI512205.1, AV141733.1, AI739826.1,
AI677235.1, AI612484.1, AU051441.1, AI415767.1, AI325757.1, AI257328.1, AA871426.1, AA869042.1, AA638053.1,
AA637947.1, AA511893.1, AA212648.1, AA114610.1, AA105703.1, W11346.1, R64480.1, AC025918.3, AI133501.1,
AP000912.1, AP000843.1, AP000832.1, AC027144.1, AC006751.1, AL161417.5, AL163544.3, AC046187.2,
AC027696.2, AC016881.4, AC016092.3, AC012571.3, AC016389.2, AC009554.4, AC018672.2, AC021846.3,
AC026465.1, AC023929.2, AC023483.2, AC010055.3, AC010017.3, AC019296.1, AC014071.1, AL138960.3,
AL354754.1, AL158825.6, Z92850.1, AC044831.2, AC020947.5, AC016620.5, AC008384.4, AC012320.4, AC060816.1,
AC062232.1, AC022325.4, AC011965.3, AC057112.1, AC055527.1, AC054947.1, AC044361.1, AC026585.2,
AC023414.2, AC009609.5, AC036460.1, AC023387.2, AC029749.1, AC026890.1, AC019016.3, AC023451.2,
AC018987.3, AC010881.3, AC013500.3, AC012259.2, AC009615.2, AC006342.1
SEQ ID NO: 401
ZH1263/T7

AK000867.1, NM_002967.1, L43631.1, AC004132.1, U72355.1, AC005544.1, AL022098.1, AL031431.8, AL031984.13,
AC004895.2, AL049759.10, AE003529.1, AC006456.2, AC005102.1, AC005122.15, AC002483.1, AC006065.3,
AF038386.1, AL133367.2, AL137143.8, AL031535.1, AP001506.1, AP001129.1, X64070.1, D58421.1, AC007797.7,
NC_001134.1, AC002072.1, AC002086.1, AC006478.2, AC006367.3, AC006062.4, AC006508.2, U96409.1, AF069442.1,
AF056324.1, AL163246.2, AL161495.2, AL109914.16, AL031846.2, AL035588.21, Z95126.1, AL035610.3, AP001537.1,
AW188258.1, AA931237.1, AI270586.1, AA157075.1, AW469488.1, AA594603.1, AA963562.1, AA133526.1,
AA625619.1, AA133527.1, AI314762.1, AW079646.1, AI195236.1, AW320448.1, AW134927.1, AW837822.1,
AW230808.1, AW209954.1, AV257871.1, AV246783.1, C88318.1, AV302078.1, AA957172.1, AI652768.1, AU016133.1,
AV261874.1, AV300983.1, AA574002.1, AV295600.1, AV116212.1, AV278604.1, AV310109.1, AV258698.1,
AA530285.1, AV269467.1, AV254504.1, AV349390.1, AV304466.1, AI908215.1, AI191742.1, AW557698.1,
AI958379.1, AI883214.1, AV298177.1, AV289122.1, AV159567.1, AV316503.1, AW352431.1, AA499071.1,
AW367834.1, AWI00004.1, AI832172.1, AI380306.1, N54920.1, M908571.1, AA958853.1, AW625559.1, AW400052.1,
AI389008.1, AV372035.1, AI950051.1, AI780357.1, AI485208.1, M440408.1, AW767522.1, AI012903.1, AW178731.1,
AV299211.1, AI981755.1, AI933364.1, AI788142.1, AI787833.1, AI747929.1, AI256435.1, AI132607.1, AI037390.1,
AA984240.1, W56148.1, N48528.1, AC025918.3, AC016297.3, AC022740.2, AC055799.1, AC018800.4, AC015772.5,
AC015771.4, AC009646.3, AC060757.2, AC022746.3, AC023320.2, AC021583.3, AC021999.2, AC020754.2,
AC011606.5, AL354453.1, AL353145.1, AL157717.2, AL157392.3, AC069133.1, AC025154.4, AC021913.4,
AC017103.3, AL157951.2, AC044856.2, AC025574.5, AC021039.3, AC016347.1, AC012670.2, AC022505.8,
AC068881.1, AC032040.2, AC010223.3, AC010002.3, AC008555.3, AC026930.2, AC016826.5, AC026635.2,
AC027815.1, AC027788.1, AC027282.1, AC027146.1, AC021859.3, AC015989.3, AC020787.2, AC011296.1,
AC005504.3, AC005958.1, AL031727.30, AL136181.5, AL355500.2, AC003022.1, AL355537.1, AL132778.3

TABLE 1-continued

Sequence homologies (GenBank Accession Numbers)

SEQ ID NO: 402
ZH1264/T3

NM_004985.1, AL355740.1, AL121850.1, L00044.1, M54968.1, X07918.1, AW163408.1, AC026758.6, AC025886.2, AC021910.3

SEQ ID NO: 403
ZH1351/T3

AF129085.1, NM_005861.1, AF039689.1, AF129086.1, Z92544.1, AF003630.1, AF003629.1, U85251.1, U85040.1,
U85039.1, NM_006114.1, NM_006326.1, AC007406.1, M60319.2, AF050154.1, AF043251.1, AF043250.1, AC005296.1,
AC005696.1, AL050075.1, AL021391.2, AJ011716.1, L19655.1, Y18007.1, M73822.1, M62862.1, NM_013379.1,
NM_015456.1, AC007968.3, AE003655.1, AE003552.1, AE003445.1, NM_011258.1, NM_006081.1, AF154502.1,
AF091504.1, AF030050.1, U07157.1, AF059678.1, AC003663.1, AI002220.1, UI5037.1, AL050280.1, AL031595.4,
AL034379.8, Z98742.5, X06542.1, D17315.1, M88489.1, U36441.1, X72711.1, AB002354.2, X75917.1, J05475.1,
X56659.1, L10425.1, U01222.1, D78638.1, AW229260.1, AA195861.1, AI930417.1, H46782.1, AW083927.1,
AA377856.1, AA838975.1, AA682253.1, AW476302.1, AL117791.1, AA316581.1, AA241988.1, AA869620.1,
AA112509.1, R36755.1, AW490920.1, AA161202.1, AI820702.1, W75327.1, R46425.1, R73232.1, AA686448.1,
AA096590.1, R54647.1, AA207360.1, H22194.1, R54607.1, AA199622.1, AA112436.1, AI663176.1,
AI663138.1, C04860.1, AI664611.1, AA243029.1, AA454484.1, AA097453.1, AI658124.1, AA081740.1, AA967978.1,
AA686534.1, AI120234.1, AW077710.1, AW499155.1, AW498183.1, AI947742.1, AI935186.1, AI712244.1, AI668229.1,
AI664974.1, AW673173.1, AW487428.1, AW248939.1, AW246826.1, AW077512.1, AI968595.1, AI968566.1,
AI873247.1, AI671905.1, AI636773.1, AI205482.1, AA848256.1, AA757274.1, AW500801.1, AW402890.1, AI941571.1,
AV063733.1, AV031907.1, AA465375.1, AA282673.1, U60304.1, W36532.1, H30685.1, AC068332.1, AC016209.3,
AC011847.3, AC011556.5, AC011531.6, AC011481.2, AC009433.2, AC012122.2, AC021988.3, AC022408.3,
AC021753.3, AC016741.2, AC022155.1, AC012116.1, AC067964.4, AC024523.2, AC027339.2, AC026730.3,
AC027731.2, AC024736.3, AC027061.2, AC021125.2, AC019312.3, AC025075.2, AC010121.6, AC009905.10,
AC020120.1, AC010913.3, AC021584.1, AC013934.1, AC012990.1, AL355880.2, AP001578.1

SEQ ID NO: 404
ZH1351/T7

AF129085.1, NM_005861.1, AF039689.1, Z92544.1, AF129086.1, Z46940.1, NM_015185.1, AE003761.1, AB007884.1,
AC016951.9, M93129.1, AL021899.1, NM_004608.1, AF038163.1, AL137480.1, AB023231.1, U53344.1, AJ007989.1,
M73980.1, Z63970.1, Z58600.1, Z64961.1, Z57538.1, AI630895.1, M971879.1, AW074238.1, AA573790.1, AI097431.1,
AI732281.1, AA775749.1, M133167.1, AI476536.1, AW272212.1, AI313142.1, AW074246.1, AA523100.1, AI922522.1,
AA977131.1, AI567504.1, AI800972.1, AW519276.1, AW007382.1, AI265896.1, AA700743.1, AI186162.1, AA156751.1,
AA872941.1, AA988951.1, AW780114.1, AA196335.1, AA777058.1, AI040100.1, AI095230.1, AI193384.1, AI884857.1,
AI147782.1, AI084116.1, AI186356.1, AA156923.1, AI263601.1, AA916340.1, AA126861.1, AA114904.1, AC13285.1,
AI367545.1, AI248132.1, AI350140.1, AI265894.1, AA113175.1, AW392245.1, AW134969.1, AI241250.1, AI829488.1,
AW769510.1, AW800139.1, AL045313.1, AA604290.1, H46715.1, R44011.1, T35752.1, AA975174.1, AI801581.1,
AA913651.1, AA100870.1, N44930.1, AW410549.1, AA358373.1, AI857353.1, F37468.1, N48716.1, AA114903.1,
AA081740.1, T31912.1, AA127292.1, W19324.1, AI954554.1, AW602696.1, AA431375.1, F36498.1, H46168.1,
AI250171.1, AI799945.1, F31326.1, AI270045.1, R73332.1, AI971264.1, R40538.1, AA034510.1, AI670750.1,
AA369419.1, R54831.1, N45564.1, T03682.1, R46339.1, AA161201.1, AI31081& 1, R54844.1, AA551976.1, AA243030.1,
T35464.1, AW632105.1, AW632304.1, R47890.1, AC068332.1, AC0162093, AC007818.6, AC023027.1, AC012366.3,
AC013071.1, AL355142.1, AC011088.8, AC022266.3, AC020772.3, AC021830.5, AC018775.3, AC016796.2,
AC024694.1, AC021051.2, AP000795.1, AC007849.6, AC048387.2, AC012645.4, AC039056.3, AC068518.1,
AC027522.2, AC021443.5, AC034149.2, AC020736.2, AC025893.2, AC026088.1, AC025540.2, AC020963.1,
AC023104.2, AC022328.4, AC009877.2, AL354697.4, AL353604.2, AL160397.4, AL159156.4, AL158196.4,
AL139331.4, AL137248.7, AL354817.3, AL157697.4, AL161793.3, AL158092.4

SEQ ID NO: 405
ZH1353/T3

NM_014497.1, D83032.1, NM_008717.1, D83033.1, AP000064.1, NM_015825.1, AE003511.1, AC003077.1,
AC010205.5, AF060568.1, AC005409.1, AC001234.1, AL110505.3, AL110485.1, Z50806.1, Z92793.1, Z81453.1,
AI239082.1, NM_001379.1, NC_001144.1, AC025436.2, AC007184.3, AC004683.2, AE003729.1, AE003505.1,
AE003436.1, AF180682.1, AC004981.1, AC008115.3, AC007091.3, AC005837.1, AL163241.2, AL163223.2,
AL133316.2, AL132716.4, Z68338.1, Z68010.1, Z83218.1, Z72520.2, AL023755.5, Z99758.7, AL035608.1,1, AL031178.1,
AL049765.16, AP001678.1, AP001696.1, AP001597.1, AP001256.2, X63692.1, Z73113.1, X91488.1, L00683.1,
AL047923.1, AL047919.1, AW083145.1, AA193367.1, AW439085.1, AI865323.1, AW665552.1, AA563264.1,
AW373007.1, AA193368.1, AU041796.1, AW852954.1, AU041432.1, AA914225.1, AA645822.1, AA167998.1,
AA167934.1, W29289.1, AW743893.1, AW728503.1, AW505299.1, AW504938.1, AW503793.1, AW500273.1,
AW376905.1, AI890946.1, AI426374.1, AI034353.1, AA714325.1, AA703165.1, W69840.1, H60273.1, R49310.1,
T05051.1, AC064868.1, AC012119.2, AC020682.2, AC012574.2, AC024105.7, AC025995.1, AC011172.4, AF217246.2,
AC061958.4, AC027256.2, AC011789.4, AC018362.3, AC015342.1, AL162573.5, AL354705.1, AL163534.3, Z92852.20,
Z98854.1, AP000774.1, AP000772.1, Z96103.1, AC021173.3, AC026904.2, AC007960.14, AC008688.6, AC010223.3,
AC011345.3, AC027115.2, AC009855.2, AC012050.1, AL356134.2, AL137075.11, AL158011.1, AP001485.1

SEQ ID NO: 406
ZH1353/T7

NM_014497.1, D83032.1, NM_014120.1, AF090903.1, NM_008717.1, D83033.1, AC004513.1, Z54366.1, AL031307.1,
AC002053.2, AF214116.1, AC0I0852.5, Z81072.1, Y17116.1, NC_001145.1, AC003105.2, AE003787.1, AE003185.1,
AF178680.1, AC006950.1, AC005960.1, AF106582.1, AF041439.1, AF019753.1, AF039232.1, AF000657.1, AL024495.1,
Y07829.2, U64804.1, AP000518.1, AK000669.1, Z74846.1, Z74845.1, Z72797.1, Z72795.1, Z48952.1, AB023055.1,
AB023054.1, Z81314.1, AB018505.1, D90353.1, X98506.1, AI357871.1, AW613119.1, AW129956.1, AA861081.1,
AA088340.1, AI949210.1, AI082565.1, AA911979.1, AA594005.1, AL047924.1, AA232142.1, AW170795.1, AI217066.1,
AI078839.1, AW193031.1, AI080190.1, AA421829.1, AA147532.1, AI242642.1, AI401436.1, AA825391.1, AI890636.1,
AW029010.1, W95261.1, AI493374.1, AW264735.1, AI253533.1, AI808939.1, D79956.1, AW080968.1, AI270468.1,

TABLE 1-continued

Sequence homologies (GenBank Accession Numbers)

AI610884.1, AL041312.1, R74381.1, AW627822.1, AA136235.1, AA136289.1, AA659078.1, AA411994.1, AI492527.1,
AW537086.1, D61038.1, AW558381.1, W95162.1, AL046548.1, AA484122.1, AW539466.1, D60905.1, AI868183.1,
AI044040.1, AW491800.1, AI235272.1, AI511149.1, AW521139.1, AA510275.1, AW609062.1, AW581790.1,
AI074733.1, AI481212.1, AA924121.1, C15661.1, AU019514.1, C86815.1, AI661220.1, AA792930.1, AA183214.1,
AA414868.1, AA402457.1, AV287351.1, AV029240.1, AV234489.1, AI608062.1, AV348633.1, AV300581.1,
AV144934.1, AA286178.1, AV322924.1, AW673523.1, AV322832.1, AV2328 83.1, AA088339.1, AV315224.1,
AA598824.1, AF017341.1, AI511965.1, AW487346.1, AA254078.1, AI223846.1, AI745175.1, AI264811.1, AW466507.1,
AW300583.1, AW175521.1, AA930184.1, AI898982.1, AI487578.1, N71735.1, AC016485.2, AF238279.1, AC007898.2,
AC021966.3, AC024100.8, AC026474.3, AC010177.3, AC012040.8, AC024022.3, AC021786.2, AC016844.3,
AC012172.3, AC021291.3, AC012301.2, AL137881.10, AL354924.1, AC036163.2, AC048373.2, AC009452.9,
AC010348.3, AC039057.3, AL139407.2,
SEQ ID NO: 407
ZH13961/T3

NC_001807.2, J01415.1, AF054990.1, X93334.1, V00710.1, V00662.1, X62996.1, D38112.1, D50525.1, X93335.1,
NC_001643.1, D38113.1, X933471 NC_001644.1, D381161 NC_001645.1, D381141 NC_002082.1, X99256.1,
NC_001646.1, D38115.1, AK000348.1, Y17174.1, NC_002083.1, X97707.1, Y17170.1, Y18621.1, NC_001992.1,
YI80011 NM_004185.1, Z71621.1, X89846.1, X02226.1, M12298.1, AL163203.2, AL050302.2, AP000026.1,
AP000025.1, U66061.1, AF029308.1, AF203727.1, U97340.1, AF203744.1, AF203743.1, AF203741.1, AF203740.1,
AL049911.2, M86493.1, M86495.1, M35875.1, M86494.1, AB019564.1 NC_0018081 NC_001567.1, 301394.1,
NC_002080.1, X88898.1, Y07726.1, V00654.1, M86497.1, M86496.1, U97337.2, U97343.1, M33552.1, AF179288.1,
AF203742.1, U97336.2, NC_001941.1, AF010406.1, AF069533.1, AJ010812.1, AB032843.1, M55539.1, M55541.1,
M86500.1, M86501.1, AF069539.1, AF069537.1, NC_001640.1, AF027999.2, M55540.1, X79547.1, NC_001601.1,
NC_002078.1, NC_002009.1, AF061340.1, AF069535.1, U97338.1, X72204.1, AJ010816.1, AJ010815.1, Y18475.1,
U97335.1, NC_001913.1, AJ001588.1, NC_001821.1, Y11832.1, NC_000934.1, AF039436.1, AJ224821.1
AW854289.1, AW854282.1, AW854273.1, AW854272.1, AW853914.1, AW853911.1, AW837655.1, AW102881.1,
AA856781.1, AA809120.1, AA809087.1, AA809068.1, AA808965.1, AA714382.1, AA578668.1, AA563919.1,
AA563906.1, AA555052.1, AA554931.1, AA554581.1, AA.554476.1, AA553856.1, AA548860.1, AA548859.1,
AA548858.1, AA218984.1, AA069787.1, AA722510.1, AA613979.1, AA595777.1, AA595749.1, AA565897.1,
AA565384.1, AA565326.1, AA564585.1, AA555049.1, AA554772.1, AA554579.1, AA548947.1, AA548856.1,
AA548348.1, AA548347.1, AA548329.1, AA548322.1, AA485 302.1, AA131338.1, AA565377.1,
AA167502.1, AW605623.1, AA565784.1, AW854396.1, AW854392.1, AW854391.1, AW854384.1, AW854275.1,
AW604467.1, AW604461.1, AW578557.1, AW578546.1, AW166949.1, AW027425.1, AI525852.1, AI281529.1,
AA868519.1, AA593698.1, AA593692.1, AA575889.1, AA554597.1, AA553425.1, AA156195.1, C17533.1, AL047740.1,
AA714377.1, AA576595.1, AA809137.1, AA595706.1, AW854391.1, AW854398.1, AW854390.1,
AW854388.1, AW854386.1, AW854385.1, AW854067.1, AW853921.1, AW837654.1, AW837523.1, AW795411.1,
AW604474.1, AW604473.1, AW601676.1, AW578558.1, AW577448.1, AA249295.1, AW854394.1, AW474560.1,
AI086871.1, AA682021.1, AA469382.1
AC024033.2, AC021914.3, AC010270.4, AC067744.2, AC026931.2, AC068619.1, AC022223.11, AC068621.1,
AC021616.4, AC016920.4, AC063928.2, AC067925.1, AC021473.3, AC015935.4, AC025337.1, AC023928.3,
AL356032.1, AL355887.1, AF182108.1, AC058808.1, AC021835.3, AL161450.4, AL121927.18, AL121909.9,
AL121898.13, AC025936.2, AC025380.2, AC021451.2, AL158819.2, AC018856.3, AC013437.3, AC013804.2,
AC021802.3, AC026086.2, AC024498.2, AL162272.3, AC024351.2, AC011029.3, AC012365.3, AL355516.2,
AL157765.1, AL356135.1, AC013272.2, AC024248.3, AL109955.13, AL135939.9, AC009499.2, AC025283.1,
AC051663.4, AC025731.7, AC018892.2, AC022264.2, AC020699.2, AC019138.2, AC017099.3, AL133466.15,
AC012349.3, AC027530.2, AC025822.4, AC067768.1, AC019174.3, AC024512.2, AC016532.2, AC021982.1,
AL138926.2, AL161738.4, AC004469.2, AC046186.2, AC018763.3, AC010438.5, AC025692.3, AC009240.3,
AC016348.3, AC012568.3, AL136316.3, AL353707.1
SEQ ID NO: 408
ZH1396/T7

AL110479.1, AW170035.1, AL157387.1, AC023885.3, AC023666.3, AC008717.3, Z98855.1
SEQ ID NO: 409
ZH148/T3

AP000354.1, AC000095.3, X91348.1, AC007744.2, AC005265.1, Z83839.1, U16027.1, AC010163.7, AE003756.1,
AC012188.2, NM_012504.1, AF115393.1, AF124366.1, AF124365.1, AC004527.2, AC006141.2, AC004050.1, U97009.1,
AL163204.2, AL157475.1, AL031670.6, AL032643.1, AP001634.1, U39650.1, X05882.1, D10359.1, U20499.1, L24160.1,
AP000525.1, M28647.1, M14511.1, Z99120.1, T19286.1, AL041214.1, AI479306.1, AV139933.1, AV077676.1,
AW610362.1, AA469910.1, T14945.1, AW851333.1, AW851196.1, AW761950.1, AW475612.1, AW258171.1,
AW230431.1, AW161704.1, AW006996.1, AW006763.1, AI952960.1, AI786648.1, AI608836.1, AI583717.1, AI378941.1,
AI227130.1, AI225655.1, AI197153.1, AI157833.1, AI119403.1, AI034178.1, AA973649.1, AA919330.1, C83508.1,
C82652.1, AA882029.1, AA871165.1, AA727880.1, Z99358.1, AA563109.1, AA510094.1, AA500957.1, AA494301.1,
AA462637.1, AA462634.1, AA446699.1, AA446572.1, AA433925.1, AA286171.1, AA268339.1, AA238626.1,
AA237522.1, AA208467.1, AA105429.1, AA105246.1, AA105755.1, AA058303.1, AA014372.1, AA014032.1, W80249.1,
W54133.1, W12919.1, N54195.1, N34293.1, R95811.1, H34521.1, T96924.1, AC011896.3, AC068808.4, AC008576.4,
AF252831.1, AF252830.1, AL157375.1, AC069072.1, AC063926.2, AC011830.3, AC020581.6, AC009329.18,
AC012645.4, AC027414.2, AC067837.1, AC011819.2, AC026881.3, AF235100.1, AC021802.3, AC012122.2,
AC027352.1, AC015991.3, AC026086.2, AC024154.1, AC022529.3, AC016724.4, AC020616.3, AC016855.3,
AC022206.2, AC023879.2, AC025266.1, AC018502.4, AC018499.2, AC011143.3, AC024260.1, AC008214.3,
AC013296.4, AC008130.5, AC012994.1, AL136227.4, AL135903.2, AL355995.1, AL355800.2, AL138801.5,
AL353581.3, AL138816.5, AL138916.5, AL161419.5, AL162502.2, AL138780.1, AL022594.18, AP001593.1, Z92862.1
SEQ ID NO: 410
ZH148/T7

AP000354.1, AC011311.11, AC003070.1, AC002455.1, AL133163.2, AL122021.3, AL096701.14, AL021939.1,
AB019534.1, AC012156.14, AC006111.2, AC000159.6, AC004079.1, AC003080.1, AC005250.1, AC005227.2,

TABLE 1-continued

Sequence homologies (GenBank Accession Numbers)

AC005326.1, AC006155.2, AC009247.11, AC005520.2, AC004797.1, AF001549.1, AC002553.1, AC004645.1,
AL078582.13, AL121653.2, AL022327.17, Z95113.2, AL,022165.1, Z84481.1, AP000065.1, AP000402.2, AP000352.2,
AC000094.3, AC067968.1, AC011445.4, AC000353.27, AC004008.1, AC002377.1, AC000085.5, AC006285.1,1,
AC007032.2, AC006040.2, AC002302.1, AC007308.13, AC004815.2, AC006387.3, AC007565.1, AC007114.7,
AC006942.1, AC004526.1, AC005562.1, AC006071.1, AC005725.1, U29895.1, AC005837.1, AC000086.1, AC005670.1,
AL163270.2, AL135978.2, AL096699.11, AL022318.2, AL022328.21, AL021578.1, AL031577.1, AL008633.1,
AL008726.1, AP001725.1, AP000694.1, AC004841.2, AC005305.1, AC007957.35, AC005251.1, AC021092.1,
AC010077.1, AC005902.7, AC005479.2, AC004791.1, AL049776.3, AL121652.2, Z97054.1, AL033524.11, AP000689.1,
AP000183.1, AP000039.1, AP000557.2, AP000556.2, AP000493.1, AP000107.1, Y12851.1, AB003151.1, AC011508.4,
AC006125.1, AC005578.1, AC004475.1, AL034429.1, AD000092.1, AL049653.7, Z82976.1, AL031282.1
AI950934.1, AA700333.1, AL037285.1, AI343233.1, AI252124.1, AW856132.1, AW833865.1, AW471332.1,
AW264986.1, AW004625.1, AI953425.1, AI744949.1, AI287475.1, AA720582.1, AA635119.1, AA634227.1,
AA613186.1, AA601237.1, AA366582.1, AA092836.1, R78877.1, AW501542.1, AW439329.1, AW243687.1, AI972613.1,
AI923052.1, AI822128.1, AI680323.1, AI564301.1, AI056701.1, AI049701.1, AI002762.1, AA745035.1, AA703900.1,
AA664365.1, AA639006.1, AA588864.1, AA579675.1, AA069619.1, W01978.1, N70179.1, N36147.1, N25272.1,
R31185.1, F02692.1, T07769.1, AW846607.1, AW131315.1, AI799545.1, AI793343.1, AA618472.1, AA516313.1,
AA515753.1, AA481779.1, AW816346.1, AW496802.1, AW468048.1, AW402688.1, AL134608.1, AW193609.1,
AW130535.1, AW129694.1, AW085740.1, AL045870.2, AW001268.1, AI884487.1, AW085740.1, M510220.1, AI676218.1,
AL048065.1, AI635475.1, AI620992.1, AI611202.1, AI610607.1, AI524371.1, AI524193.1, AI510838.1, AI311647C1,
AA846935.1, AA774127.1, AA737106.1, AA578847.1, AA558048.1, AA525206.1, AA448221.1, AA359041.1,
AA219006.1, AA134959.1, AA007673.1, W38404.1, N72717.1, N71291.1, N69517.1, N68472.1, H72530.1, H70076.1,
R84302.1, R08815.1, T58114.1, AI056792.1, W52505.1, AC011896.3, AC016638.4, AC067727.1, AC016562.3,
AC009097.5, AC013291.4, AC016404.2, AC018814.3, AC021584.1, AC016426.1, AC013312.2, AC015813.1,
AL139150.1, AC018711.3, AL354932.4, AL161647.5, AL138781.3, AL139141.4, AL355534.1, AL163051.1, AL138733.2,
AC055747.1, AC013644.3, AC025552.3, AC024509.2, AC013489.3, AL355978.1, AP001261.1, AC015551.8,
AC022130.3, AC020904.5, AC011452.5, AC008945.3, AC020983.4, AC018663.1, AC023499.3, AC027812.2,
AC068074.1, AC009314.3, AC027057.2, AC026653.2, AC016700.2, AC016837.3, AC019095.2, AC011216.3,
AC024511.2, AC022594.3, AC024366.1, AC004555.2, AL139098.4, AL139410.2, AL033529.16, AL136293.2,
AL139388.1, AC036208.2, AC036174.2, AC055781.2, AC068785.4, AC061970.2, AC032036.2, AC027324.2,
AC012615.3, AC008828.3, AC008689.4, AC018636.1, AC016582.4, AC011495.3, AC010319.6, AC025483.2,
AC023771.4, AC021016.3, AC011736.3, AC016496.3, AC023343.2, AC012185.3, AC021736.3, AC015878.4,
AC008026.2, AC009427.2, AC024601.2, AC016730.4, AC000005.1, AC018391.4, AC006286.13, AC022460.2,
AC010684.3, AC006342.1, AL354935.3, AL132868.12, AL158212.4, AL353701.1, AL160000.2, AL138842.2,
AC023053.7, AC019205.3, AC012002.3, AL109804.26, AL158815.4, AC032035.2, AC026125.1
SEQ ID NO: 411
ZH119/T3

AF126008.1, AF127481.1, NM_006738.1, U03634.1, NM_012026.1, U73199.1, AC004815.2, AP000058.1, AC018452.10,
NM_004723.1, NM_002728.1, U72206.1, AL157431.1, AB014551.2, Z26248.1, AF113018.1, AC000365.1,
NM_006074.1, AC006560.8, AF110972.1, AF110969.1, AF098098.1, AF098089.1, AF098081.1, AF038115.1,
AF014101.1, AF056139.1, AF056137.1, AF056130.1, U65549.1, U65072.1, AC005622.1, AF053298.1, AF053281.1,
AF045631.1, U47100.1, U86769.1, U56368.1, U58797.1, Z98044.13, AL049766.14, Z68870.1, AL034417.14, U08455.1,
AP001437.1, AP000411.1, AP000011.2
AI080516.1, AA680040.1, AA160400.1, AV175589.1, Z18299.1, AW239879.1, AW368143.1, AL138205.1, AA471378.1,
AA190443.1, AW561862.1, AW561797.1, AW561792.1, AW561783.1, AW166107.1, AV323271.1, AW080955.1,
AW026304.1, AW003886.1, AI997942.1, AI969095.1, AI944384.1, AI783154.1, AI751341.1, AI723669.1, AI723667.1,
AU068139.1, AI570753.1, AI545330.1, AI500562.1, AI309847.1, AI234422.1, AI234414.1, AI133003.1, AI052895.1,
AI052878.1, AA933127.1, AA835773.1, AA808246.1, AA742198.1, AA720586.1, AA491530.1, AA489204.1,
AA406885.1, AA395608.1, AA228562.1, AA228561.1, AA228541.1, AA142390.1, AA083407.1, AA083478.1,
AA051057.1, AA050677.1, W59866.1, W54301.1, W51561.1, W51638.1, W51531.1, N81361.1, N43467.1, H67519.1,
H67518.1, AC068402.1, AC007897.2, AC021739.1, AC044822.1, AC026840.1, AC023885.3, AC055760.2, AC011386.4,
AC023190.2, AC015685.2, AC007430.17, AC023599.7, AC040906.2, AC008862.5, AC010862.5, AC040304.3,
AC026521.2, AC026770.3, AC009994.4, AC026657.3, AC010727.3, AC040920.1, AC007601.2, AC021420.3,
AC021814.2, AC021811.2, AC022195.2, AC024732.2, AC024329.2, AC013282.3, AC015762.2, AC016747.3,
AL353194.5, AP001895.1, AP000869.1
SEQ ID NO: 412
ZH119/T7

NM_002439.1, U61981.1, J04810.1, D61418.1, D61419.1, D61416.1, D61417.1, M80360.1, L10317.1, L10316.1,
L10318.1, AL163284.2, L10319.1, U41038.1, AL022316.2, AL1218151 NC_001147.1, AF132734.1, AC007211.5,
M60855.2, AE003766.1, AE003677.1, AE003629.1, AF221096.1, U91324.1, AF156865.1, AF156864.1, AF156863.1,
AF156862.1, AE001707.1, AF105197.1, AF105192.1, AF105191.1, AF105181.1, AF105173.1, AF105172.1, AF105171.1,
AF105170.1, AF105163.1, AF105162.1, AF105I61.1, AF105I60.1, AF105158.1, AF105157.1, U55020.1, AC002553.1,
AC002549.1, U67508.1, AF013754.1, AL121965.19, AL138996.2, K02212.1, AL132708.3, AC000123.1, AL035086.12,
AL035258.10, X55746.1, X55752.1, Z75058.1, ABO15472.1, AW069265.1, AI888396.1, AI000562.1, AA969963.1,
AA587200.1, AW321566.1, AI495086.1, AV427755.1, AV413150.1, AV411521.1, AI674413.1, AW795485.1,
AW700074.1, AW576548.1, AW558153.1, AW320131.1, AW302482.1, AW273452.1, AW172797.1, AV331283.1,
AV382870.1, AW041682.1, AI982667.1, AI953902.1, AI937839.1, AI820081.1, AI819300.1, AI814500.1, AI744664.1,
AI742562.1, AV044143.2, AI658876.1, AI658322.1, AI657880.1, AI556716.1, AI537928.1, AI494668.1, AI358429.1,
AU031621.1, AI176155.1, AI072955.1, AA948029.1, AA703667.1, AA686049.1, AA582962.1, AA558493.1,
AA550767.1, AA542978.1, AA534864.1, AA533877.1, AA475323.1, AA349463.1, H07126.1, H06698.1, R49574.1,
R16987.1, AC008557.5, AC016565.4, AC022493.7, AC021649.9, AC021065.3, AC010594.4, AC008824.4, AL121837.13,
AJ011929.1, AC040890.1, AC024996.2, AC013803.3, AC013772.3, Z98869.1, AC027648.6, AC060788.2, AC024108.5,
AC058823.2, AC018764.4, AC010263.4, AC008771.3, AC022415.4, AC012618.3, AC011511.4, AC009617.4,
AC021063.11, AC013361.4, AC064794.1, AC062036.1, AC023108.3, AC011287.3, AC027217.2, AC044847.1,
AC009924.4, AC025033.4, AC019351.3, AC016714.2, AC007223.1, AC016294.2, AC024314.1, AC008093.3,

TABLE 1-continued

Sequence homologies (GenBank Accession Numbers)

AC023714.2, AC009490.5, AC019072.1, AC007300.5, AC017445.1, AC018047.1, AC010936.2, AC014353.1,
AL135790.2, AL356011.1, AL121714.29, AL355609.1, AL138816.5, AL355552.1, AL117259.2, AL157764.1
SEQ ID NO: 413
ZH1331/T3

AB002374.1, AP000354.1, AC000095.3, X91348.1, AC004702.1, AJ009615.2, AL021367.1, AC007744.2, AC005265.1,
AF036702.1, AL138996.2, Z83839.1, U16027.1, AC010498.4, U78721.2, AE003817.1, AE003756.1, AC012188.2,
NM_012504.1, NM_005426.1, AF115393.1, AF124366.1, AF124365.1, AF076337.1, AC004527.2, AC005977.3,
AC004050.1, U97009.1, U58334.1, AC004638.1, AC004587.1, AL163222.2, AL163204.2, AL161547.2, AL021889.2,
AL157475.1, AL031670.6, AL032643.1, Z85999.1, AL035555.10, A8026898.1, AP001677.1, AP001634.1, U42462.1,
AP000946.3, L13696.1, U39650.1, X05882.1, D10359.1, U20499.1, L34160.1, AP000500.1, M28647.1, M14511.1,
Z99120.1, AW504383.1, AA564137.1, AL044805.1, T19286.1, AL041214.1, AV315094.1, AW483783.1, AI479306.1,
AW732340.1, AW297086.1, AV077676.1, AW610362.1, AI793990.1, AA469910.1, T92706.1, AW851333.1,
AW851196.1, AW761950.1, AW475612.1, AW258171.1, AW230431.1, AL121236.1, AW006996.1,
AW006763.1, AI952960.1, AI917611.1, AI786648.1, AI608836.1, AI583717.1, AI378941.1, AI227130.1, AI225655.1,
AI197153.1, AI157833.1, AI119403.1, AI034178.1, AA973649.1, AA919330.1, C83508.1, C82652.1, AA882029.1,
AA871165.1, AA727880.1, Z99358.1, AA563109.1, AA510094.1, AA500957.1, AA494301.1, AA462637.1, AA462634.1,
AA446699.1, AA446572.1, AA433925.1, AA336354.1, AA290953.1, AA286171.1, AA279957.1, AA268339.1,
AA238626.1, AA237522.1, AA208467.1, AA105429.1, AA105246.1, AA105755.1, AA058303.1, AA014372.1,
AA014032.1, W80249.1, W54133.1, W12919.1, N54195.1, N34293.1, R95811.1, H34521.1, T96924.1, Z45637.1,
AC011896.3, AC068808.4, AC011318.7, AC012020.8, AC008576.4, AC022319.3, AC019297.4, AC012340.2,
AC015922.1, AL354046.2, AC027332.2, AC026432.2, AC011400.4, AC010625.3, AC008467.4, AC068004.1,
AC012053.2, AF252831.1, AC010719.3, AC016664.2, AC015455.2, AL158848.2, AL157375.1, AC069072.1,
AC063958.6, AC068736.1, AC009329.18, AC012645.4, AC027414.2, AC027478.2, AC007485.2, AC009643.3,
AC011819.2, AC021798.5, AC023437.2, AC034290.1, AC026881.3, AF235100.1, AC021802.3, AC027352.1,
AC015991.3, AC026086.2, AC022402.2, AC023048.4, AC016855.3, AC023399.2, AC018499.2, AC018946.4,
AC024260.1, AC022711.1, AC010989.3, AC020328.1, AC013502.1, AL355995.1, AL355800.2, AL138916.5, Z92862.1
SEQ ID NO: 414
ZH1331/T7

NC_001807.2, J01415.1, X93334.1, V00710.1, V00662.1, X62996.1, D38112.1, AF054990.1, D50525.1, X93335.1,
NC_001643.1, D38113.1, NC_001644.1, D38116.1, X93347.1, NC_001645.1, D38114.1, Y17170.1, NC_002082.1,
X99256.1, NM_004185.1, Z71621.1, NC_002083.1, X977071 NC_001646.1, D38115.1, AB019564.1, AB017708.1,
Y17174.1, M12298.1, U66061.1, AK000348.1, Y18621.1, X02226.1, NC_001992.1, Y18001.1, AF029308.1, Z70759.1,
U25123.1, AF179290.1, AF203741.1, AF203744.1, AF203743.1, AF069537.1, NC_002391.1, Y19192.1, NC_001779.1,
X97336.1, U78342.1, AF069536.1, AJ010812.1, NC_002009.1, AF061340.1, AB033608.1, AB032843.1, NC_0019131
U97343.1, AJ001588.1, AF069534.1, AF203737.1, AF203727.1, AF069539.1, Y17323.1, AF203742.1, M86497.1,
NC_000845.1, AF034253.1, NC_001808.1, Y07726.1, NC_001700.1, U20753.1, AF203740.1, AF069538.1, M86493.1,
M86495.1, NC_000889.1, NC_002080.1, X88898.1, AJ010815.1, AJ010813.1, AJ010957.1, U97337.2, AF203773.1,
M55539.1, AF179288.1, U97336.2, AJ010516.1, AJ010814.1, M86500.1, M86501.1, AF203738.1, AB032842.1,
NC_001892.1, AJ001562.1, A3010817.1, M55540.1, NC_002078.1, AF069535.1, U97338.1, Y18475.1, AL047740.1,
AI132911.1, AW837660.1, AI048631.2, AI114672.1, AW837523.1, AW837524.1, M132942.1, AW854289.1,
AI065135.1, AW854384.1, AW853921.1, AW604474.1, AW854382.1, AW854396.1, AW853914.1,
AW604461.1, AW854390.1, AW854398.1, AW854407.1, AW854392.1, AW604467.1, AW862475.1, AW860484.1,
AW854391.1, AW854386.1, AW854385.1, AW854277.1, AW854067.1, AW601879.1, AW854388.1, AW854273.1,
AW604473.1, AW604460.1, AW854394.1, AW854399.1, AW749569.1, AW578557.1, AW860501.1, AW860487.1,
AW601822.1, AW610382.1, AW862468.1, AW860495.1, AW601876.1, AW862475.1, AW860488.1, AW860482.1,
AW835481.1, AW860489.1, AW860470.1, AW860493.1, AW860491.1, AW853994.1, AW601877.1, AW862476.1,
AW860499.1, AW860498.1, AW860497.1, AW601827.1, AA156195.1, AW860486.1, AW854070.1, AI110658.1,
AW862464.1, AW860504.1, AW860506.1, AW860485.1, AW860473.1, AW749572.1, AA837501.1, AW854272.1,
AW862472.1, AW862471.1, AW862466.1, AW860503.1, AW835494.1, AW578566.1, AW860474.1, AW862469.1,
AW835385.1, AW862474.1, AW835474.1, AW854275.1, AW854271.1, AW610324.1, AA211604.1, AW835492.1,
AW835359.1, AW601869.1, AW835497.1, AI525852.1, AW578558.1, AW605188.1, AW578546.1, AA722510.1,
AA593692.1, AA101199.1, AL036513.1, AC024033.2, AC010270.4, AC021914.3, AC022223.1,1, AC021616.4,
AC026931.2, AC016920.4, AC068619.1, AC063928.2, AC013804.2, AC068621.1, AC067925.1, AC021473.3,
AC018856.3, AC013437.3, AC024498.2, AC021835.3, AC015935.4, AL161450.4, AL356032.1,
AL355887.1, AC023928.3, AC025380.2, AL158819.2, AC058808.1, AC024248.3, AC025337.1, AL121927.18,
AF182108.1, AZ021451.2, AL121909.9, AL121898.13, AC051663.4, AC025731.7, AC025936.2, AL109955.13,
AL135939.9, AC021802.3, AC026086.2, AC024351.2, AC011029.3, AL355516.2, AL157765.1, AL356135.1,
AC009499.2, AC025283.1, AC019138.2, AC013632.3, AC024250.4, AC009240.3, AL161738.4, AC008024.2,
AL138926.2, AL133466.15, AL353147.3, AC013290.3, AC067768.1, AC019174.3, AC024512.2, AC016532.2,
AC021982.1, AL355923.1, AP001571.1, AC069151.1, AC069141.1, AC004469.2, AC046186.2, AC024659.3,
AC025692.3, AC021544.4, AC025388.2, AC022220.4, AC021860.3, AC023248.2, AC013480.3, AL157950.3,
AL355032.1, AL109945.1, AL136454.3, AP001393.1
SEQ ID NO: 415
DKFZp434B094

AF005067.1, AL080149.1, Z98885.1, AB033112.1, Z84485.1, NM_004634.1, AF176815.1, M91585.1, X64746.1,
X64745.1, AE003841.1, AF203193.1, AF203192.1, AF203160.1, AF203138.1, AF203137.1, AF203118.1, Ay129334.1
U37269.1, U37268.1, AF064681.1, AF064680.1, AF064679.1, AF064678.1, U23487.1, AK000751.1, M58271.1,
M58270.1, M58269.1, M58268.1, M58267.1, M58266.1, M58265.1, M58264.1, M58263.1, M58262.1, M58261.1,
M58260.1, M58259.1, M58258.1, M58257.1, M58256.1, M58255.1, MS 8251.1, M58212.1, MS 8207.1,
M58200.1, M58194.1, M58186.1, M58183.1, M58179.1, AF203182.1, AF110401.1, U27443.1, AF203140.1, AF203139.1,
AF203120.1, AF203119.1, NM_006751.1, AF174703.1, AF174702.1, AF174701.1, AF174698.1, AF174696.1,
AF079325.1, AF120917.1, AF120916.1, AF120915.1, AF120914.1, AF120913.1, AF120912.1, AF120909.1, AF129381.1,
U03340.1, U03338.1, AF082358.1, AL035703.20, M61199.1, AK001633.1, Z11812.1, AJ233022.1, AB014600.1,
L15492.1, X07985.1, AL041903.1, AL040577.1, AW408719.1, AW176308.1, AW748208.1, H55108.1, AA340707.1,

TABLE 1-continued

Sequence homologies (GenBank Accession Numbers)

AV118538.1, AA930693.1, AW369905.1, H11686.1, M79139.1, D76571.1, H11889.1, AJ397954.1, AW674903.1,
AF034196.1, AI907910.1, T98019.1, AA759003.1, AW752395.1, AW375924.1, AL047827.1, AI594388.1, AI551828.1,
M514970.1, AA990859.1, AA948792.1, AA615805.1, AA461239.1, AA428908.1, AA325161.1, AA187577.1,
AA158452.1, AA076152.1, AA045603.1, W94477.1, W46356.1, W38747.1, N98297.1, H65630.1, H65071.1, R93581.1,
R07789.1, T97395.1, T87592.1, AW737888.1, AW721225.1, AW598032.1, AW410598.1, AW398350.1, AW376978.1,
AW289794.1, AV391484.1, AW216360.1, AW047869.1, AI969973.1, AI948717.1, M710520.1, AI705195.1, AI499756.1,
M454951.1, AI029325.1, AA859441.1, AI263045.1, AI175427.1, AI175396.1, AI170788.1, M103955.1, AI076494.1,
AI076474.1, AA843382.1, AA653055.1, AA467735.1, AA448354.1, AC063971.1, AC008034.13, AC066599.1,
AC018829.3, AC011610.5, AC021996.1, AC022382.1, AC008117.2, AL160033.6, AL162499.3, AC012738.1,
AC009739.2, AC005425.3, AC021030.5, AC068893.1, AC021031.2, AC020909.4, AC021041.3, AC021033.2,
AC022282.1, AC012285.1, AL079336.13, AL138703.2, AL353576.1, AC010789.8, AC048356.2, AC008737.6,
AC024591.2, AC009108.6, AC023592.2, AC025929.2, AC015867.2, AC021769.3, AC020962.1, AC016774.2,
AC010189.3, AC009962.3, AC020260.1, AC017435.1, AC007328.4, AL138809.13, AL133420.23, AL354919.4,
AL139160.1
SEQ ID NO: 416
DKFZp434p228

AL117590.1, AC007245.3, AC003683.1, AL355072.2, AC005L20.1, AC006214.1, AL161550.2, AL021687.1,
AC007063.5, AC004535.1, AC013453.1, AF092369.1, AC004752.1, AL049777.5, AL096862.18, AL132764.1,
AP000226.1, D85389.1, AC011493.4, AC005662.2, AC002354.2, AE003163.1, AC021640.5, AC007536.9, AE00136&1,
AF100956.1, AC004629.1, AL163232.2, AL031177.1, AL031733.3, AL031653.5, AP001687.1, M77182.1, M75889.1,
AA175375.1, AI740728.1, AA332493.1, AW874606.1, AI810796.1, AI087846.1, AI074062.1, AI016838.1, AA470819.1,
AI580915.1, W85623.1, W85600.1, AI449083.1, AI549242.1, AI845400.1, AI383006.1, AV0 35395.1, AV375672.1,
AV327111.1, AI741614.1, AV354227.1, AV300969.1, AV376539.1, AV283831.1, AV253424.1, AW122375.1,
AI604667.1, AA771574.1, AW332467.1, AW642408.1, AW636829.1, AW635398.1, AW634742.1, AW634652.1,
AI4.67036.1, AA285835.1, AL135649.1, AV377755.1, AI915385.1, AV173187.1, AV064014.1, AV062554.1, AI347646.1,
AA808321.1, AA525659.1, AA458724.1, AA232022.1, AA118229.1, RI 2836.1, T37449.1, AC034212.3, AC022121.3,
AC008522.4, AC008531.2, AC011129.3, AC021824.2, AC023528.3, AC036206.2, AC020916.4, AC023808.3,
AC025449.3, AC019274.3, AC015595.3, AC006280.6, AC022977.1, AC013702.2, AL137780.2, AL135926.4,
AC048385.2, AC032009.2, AC005077.2, AC027637.2, AC021515.3, AC013658.3, AC019328.4, AC021562.3,
AL354805.2, AL139284.3, AL355811.2, AL035477.5, AL034557.7, AL031749.7,
SEQ ID NO: 417
Ovarian Cancer downregulated myosin NM_014890.1, U53445.1, AC004020.1, Z46792.1, AE003832.1, AC007557.3, AE001808.1, Z82203.1, X52075.1,
M61827.1, AF104477.1, U60149.1, AF003530.1, AC000403.1, AL096867.15, Z82268.1, Z79758.1, A.T011002.1,
M32612.1, AF130358.2, AC004021.1, AC007560.3, AC005834.1, AL034419.19, AL133244.1, AL139076.2, AL021171.1,
Z82899.1, AL096769.7, U70850.1, U58751.1, AW779584.1, AW867011.1, AW779587.1, C05084.1, AW779590.1,
AI642381.1, AW751244.1, AI606223.1, AW779641.1, AA611335.1, AA990984.1, AI940062.1, AV292155.1,
AA611336.1, AV343292.1, AV089962.1, M549138.1, AI554667.1, AI553756.1, AI402221.1, AI202123.1, M084203.1,
D75522.1, R54298.1, AW309190.1, AV194167.1, AI614167.1, AI587990.1, AA964335.1, AI068552.1, AA666699.1,
C55082.1, AA497874.1, AA196522.1, AW871954.1, AW208053.2, AW467155.1, AW459498.1, AW439057.1,
AW401003.1, AW325166.1, AW322018.1, AV369587.1, AW168998.1, AV339384.1, AV259982.1, AV245839.1,
AW104948.1, AW076711.1, AI988870.1, AI854627.1, AI843433.1, AI835147.1, AI765820.1, AI733300.1, AI733105.1,
AI536969.1, AI494412.1, AA998598.1, AI429807.1, AI347598.1, AI228563.1, AI049016.1, AA910905.1, AA629377.1,
AA623952.1, AA537555.1, AA387953.1, AA386853.1, AA274292.1, W97823.1, U31683.1, H09936.1, T69472.1,
AC022883.3, AC024938.7, AC069222.1, AC034172.2, AC007330.5, AC015178.1, AC010696.2, AL161632.4,
AC025318.2, AL353632.4, AL353144.1,
SEQ ID NO: 418
KIAA0103

NM_014673.1, DI 4659.1, AC004492.1, AC009233.3, Z99133.1, AC004838.2, AF048726.1, AJ243213.1, AL033392.5,
AF146342.1, AC005875.2, AC007421.12, AF028834.1, Z99135.1, AJ232463.1, AJ232461.1, A.1232460.1, AJ232439.1,
AJ232458.1, AJ232456.1, AJ232466.1, AJ232465.1, AJ232464.1, AJ232454.1, AJ232501.1, AJ232462.1, L21948.1,
X68253.1, NC_001224.1, AE003578.1, AC007911.8, AC004802.1, AL110292.4, AL034556.3, AI272279.2, AI011856.1,
AL034561.4, AL031427.15, NC_0011372 AE003519.1, AF030694.2, AC004926.2, AC007402.3, AC005230.1,
AC006199.1, AL137228.2, AL021395.15, Z72652.1, X87252.1, U07978.1, AL048716.3, AA447858.1, AI636359.1;
AI669342.1, AI669343.1, AI027953.1, AI566150.1, AW276600.1, AI339009.1, AA447703.1, AA887811.1, AI147898.1,
AI679455.1, AA836064.1, AA873375.1, AL038161.1, AA534251.1, AJ422.353.1, AA745251.1, AA708596.1,
AW130877.1, AW168287.1, AW303995.1, AW204529.1, AI677854.1, AI420890.1, AA935810.1, AA938493.1,
AA687160.1, AI557375.1, AA311297.1, AA821444.1, T27967.1, AW583644.1, AA301507.1, AW583578.1, AA855729.1,
AA935814.1, AA385797.1, AA560410.1, AA870575.1, N50202.1, AA301506.1, AA683177.1, AA471359.1, C83495.1,
C82639.1, AA003181.1, AI525324.1, AA545015.1, AA137986.1, AA163006.1, AA187086.1, N680481, AI555299.1,
AW009849.1, AW198055.1, AA638895.1, AA530808.1, AA181333.1, AW592606.1, AI104356.1, AW209495.1,
AW644280.1, AA893851.1, AI014068.1, AA067766.1, AI234816.1, AW765060.1, AI204083.1, AI156263.1,
AW646028.1, AW123869.1, AW539200.1, AI102630.1, AV171265.1, AI556341.1, L26817.1, AA248265.1, AA797564.1,
AI843449.1, AW639641.1, AV250940.1, AI616839.1, AV260102.1, AV257129.1, AV253184.1, AV251229.1,
AV249657.1, AW124329.1, AV172897.1, AV151001.1, AV127867.1, AV113481.1, AV088039.1, AV087721.1,
AV060620.1, Z36450.1, AW764367.1, AV040300.2, AC022634.3, AC019351.3, AC025826.1, AL138828.4, AC058784.2,
AL355972.2, AL354717.3, AC068992.3, AC053499.2, AC018608.4, AC023075.2, AL353573.2, AL158149.3,
AL138974.2, AL138683.2, AP002078.1, AC011186.3, AC023492.2, AL138920.2, AP000878.1, AC026119.5,
AC023757.4, AC011257.3, AC016319.2, AC027073.2, AC025999.3, AC025380.2, AC023444.2, AC026224.1,
AC016105.3, AC022812.2, AC024512.2, AC008182.1, AL161796.3, AL353789.1,

TABLE 1-continued

Sequence homologies (GenBank Accession Numbers)

SEQ ID NO: 419
Cosmid NFG9

AF126531.1, Z69719.1, NM_016310.1, AF051316.1, AE003791.1, AC067965.1, AC005034.1, AE0021021
AL109943.18, Z98946.15, Z68887.1, Z50112.1, D88193.1, M97636.1, AE002705.1, AC018363.6, AC005018.2, U80837.1,
AL021492.1, AB018007.1, AC002054.5, AC002049.4, AE003632.1, AC002045.1, AC002544.1, AC002395.1, M94081.1,
AL163279.2, Z98551.1, AE000662.1, AL034556.3, AL031662.25, AL022326.1, Z49237.1, AL021713.1, AW167513.1,
AW138186.1, AI760367.1, AI224102.1, AI094028.1, AI074736.1, AI369802.1, AI220149.1, AI313394.1, AI082184.1,
AA263042.1, AI569242.1, AA314434.1, AI241541.1, AA126951.1, AA912503.1, AI913788.1, AW275005.1, AA773182.1,
AW418739.1, AA827399.1, AA669773.1, AI268800.1, AA476966.1, AI868548.1, AW672863.1, AW385705.1, C00817.1,
AI368581.1, AA837254.1, AA352782.1, AW426495.1, AW381929.1, AW429636.1, AW426017.1, AA604039.1,
AW785359.1, AW793665.1, AW675452.1, AA271604.1, W98752.1, AA009299.1, W59077.1, AI286727.1, AA118991.1,
AI122511.1, W64539.1, AA822533.1, AA199237.1, AA051263.1, AA537627.1, AA590075.1, AA198139.1, AI858883.1,
AW488481.1, AA268809.1, H31197.1, AW484117.1, AW484121.1, AA691124.1, AW003500.1, AW528612.1,
AA120383.1, AI415794.1, AW637653.1, AU014893.1, AA606218.1, AW452227.1, AA413355.1, AW739254.1,
AA736083.1, AA696686.1, AW346361.1, AU039136.1, C92913.1, C90605.1, C90570.1, AA148320.1, T67650.1,
AW191223.1, AU076341.1, AV011661.1, AC010552.3, AC007604.1, AP001005.1, AC020707.2, AC018350.2,
AC015996.2, AC016708.3, AC009218.6, AC016019.3, AC020202.1, AC007837.3, AC015972.3, AC016997.4,
AC013404.1, AL355886.1, AL109769.2, AC010376.3, AC012316.4, AC019293.3, AC025335.2, AC023014.2,
AC016226.1, AL158213.3, AC044809.2, AC040951.2, AC026709.2, AC025228.2, AC011606.6, AC069127.1,
AC051619.2, AC012645.4, AC021546.3, AC011967.3, AC044828.1, AC026542.2, AC007718.2, AC019253.3,
AC012107.2, AC026293.1, AC021145.3, AC021999.2, AC014357.1, AC015685.2, AC013812.2, AL356139.2,
AL162731.2, AL136360.7, AL121922.7,

SEQ ID NO: 420
Zinc finger DNA binding Protein 89 kDa

AJ236885.1, L04282.1, AF039019.1, NM_011749.1, X98096.1, U30381.1, U80078.1, AJ001165.1, AE003846.1,
AC007842.1, AF034212.1, AC005614.1, AC000385.1, AL133244.1, AL121656.2, AE003657.1, AC011662.1,
AC005125.9, AC007159.4, U63996.1, U69886.1, AL049648.6, AJ233997.1, AC007444.1, AC009312.3, AC008806.4,
AE003754.1, AE003604.1, AE003583.1, NM_009445.1, NM_006526.1, AC009519.4, AF085244.1, AF085243.1,
AC005552.1, AF083213.1, U32370.1, U30930.1, U09410.1, AF041259.1, AC004276.1, AF042090.1, AL163282.2,
AL163224.2, Z83102.1, AL133070.1, AL031119.1, AP001679.1, AP001251.1, AB019227.1, M86377.1, AJ006687.1,
AL038916.1, AW261045.1, AI158501.1, AA967471.1, AW425025.1, AI397213.1, AI385079.1, AW761766.1,
AW740903.1, AV382076.1, AV379589.1, AV376903.1, AV370752.1, AV366011.1, AV364877.1, AV362453.1,
AV352764.1, AV330621.1, AV294425.1, AV287896.1, AV268554.1, AV252401.1, AV252233.1, AV252222.1,
AV218661.1, AV205194.1, AV157405.1, AV145061.1, AV139670.1, AV123571.1, AV116788.1, AV116109.1,
AV114001.1, AV086136.1, AV085658.1, AV063815.1, AV014975.1, AV011220.1, M450743.1, AJ427142.1,
AV305534.1, AV260003.1, AV167614.1, AV167001.1, AV165826.1, AV164748.1, AV123378.1, AV116499.1,
AV112070.1, AV106069.1, AV102663.1, AV087776.1, AV087432.1, AV040082.2, AI093969.1, AV440147.1,
AW667700.1, AW637787.1, AW619431.1, AW619430.1, AW381210.1, AW359900.1, AW344493.1, AW004526.1,
AI853184.1, AI749512.1, AI380386.1, AA979011.1, AA911993.1, AA790790.1, AA784573.1, AA413750.1, AA197666.1,
D86150.1, W27300.1, W05407.1, R19845.1, F08171.1, P06005.1, AC019289.3, AC032043.1, AC026618.1, AC013470.3,
AC018137.1, AC010577.3, AL158034.2, AC068587.1, AC027238.2, AC020598.3, AC016812.4, AC019180.4,
AC011626.2, AC020648.4, AC009770.4, AC027193.2, AC040911.1, AC023143.3, AC015652.6, AC027362.1,
AC026243.2, AC015653.3, AC011936.4, AC023944.2, AC018208.1, AL139189.4, AL354939.3, AL354985.2,

SEQ ID NO: 421
ZH016/T3

AL080129.1, AK000323.1, X77864.1, AC006264.3, AE001806.1, AL035070.3, Y10300.1, AC002480.1, NM_0022331
AC007388.3, AL021713.1, U41026.1, M60450.1, M55514.1, AB010700.1, L02751.1, AL021710.1, AE003592.1,
AC007074.2, AL163236.2, AL109853.4, AP001691.1, AK001569.1, AI537278.1, AI962481.1, AW031973.1,
AW031386.1, AA5564.62.1, AL135530.1, M467338.1, AC001406.1, W05978.1, R58296.1, AV426794.1, AW771615.1,
AW333984.1, AW234785.1, AV252087.1, AW056318.1, AW020852.1, AI997421.1, P35664.1, AI564380.1, AU050836.1,
AI374842.1, AI368114.1, AI267738.1, AI237631.1, AI109659.1, AI030899.1, AA894082.1, AA892550.1, AA850999.1,
AA800262.1, AA484703.1, AA283112.1, C18888.1, C18806.1, C18709.1, C18634.1, C18537.1, C18508.1, C18440.1,
C18423.1, C18367.1, C17766.1, C17601.1, C17529.1, N74722.1, N52480.1, H02379.1, R33543.1, AC009497.2,
AC019029.3, AC048380.2, AC024025.3, AC024288.2, AC007498.3, AC055880.2, AC021708.2, AL159989.3,
AC027414.2, AC021172.3, AC013291.4, AC017355.1, AL137184.3, AL117259.2, AC064849.2, AC067830.1,
AC026993.2, AC009427.2, AC024043.4, AC021252.3, AC023069.2, AC024056.2, AC016822.2, AC020166.1,
AC010731.2, AL139118.4,

SEQ ID NO: 422
ZH016/17

AK000323.1, U79263.1, AC009363.4, AC007182.3, AC007504.3, AC007057.3, AL049872.3, AC006477.3, AC002073.1,
AL034393.1, U 15668.1, AB018573.1, AB025619.1, AC007458.13, AE003648.1, AL096712.20, AP000884.1, AI970820.1,
AA831852.1, AA484320.1, AA226748.1, AI968567.1, AA363215.1, AA301296.1, R38172.1, AA371109.1, AI045735.1,
AU016181.1, AI852657.1, AA684481.1, AA546723.1, AW549474.1, AA155568.1, AV313936.1, AV273922.1,
AW359195.1, AU072042.1, AW727402.1, AV077600.1, AA866444.1, AW392740.1, AW279154.1, AW234824.1,
AV089525.1, AI454887.1, AA441693.1, AA318189.1, N48302.1, AC019029.3, AC009497.2, AC066604.1, AC026182.2,
AC022918.2, AC027489.2, AP001913.1, AP001565.1, AP001392.1, AC011101.3, AL031113.1, AC069157.1,
AC055808.2, AC025633.3, AC024699.2, AC016107.3, AC016471.4, AC005308.6, AL049183.5,

SEQ ID NO: 423
ZH032/T3

AC004985.2, AB040940.1, AC007882.3, AC011456.2, AC002041.1, AC004583.1, AE003586.1, AC004439.1,
AL049794.13, AC230312.1, AW861788.1, AW858314.1, AW861758.1, AW858265.1, AA050850.1, AI078919.1,
F23291.1, AL353701.1, AL159997.3, AC022915.2, AC010539.3, AC025138.2, AC026495.1, AC024930.3, AC021169.2,

TABLE 1-continued

Sequence homologies (GenBank Accession Numbers)

AC024283.2, AC007908.2, AL158155.2, AC027309.2, AC068518.1, AC020796.2, AC022858.3, AC016234.3, AC009989.6, AC022639.1, AC016276.2, AC017951.1, AC006514.6, AL133462.13, AL157700.2, AL133352.10, AL157858.1,
SEQ ID NO: 424
ZH032/T7

AI675618.1, AL121389.1, AI953917.1, AI670867.1 M420775.1, AI199226.1, AA570572.1, AA577683.1, AI801384.1, AA599079.1, AI678864.1, AI673355.1, AI743710.1, AI973140.1, AI473720.1, AW168045.1, AI750437.1, AA918762.1, W78002.1, AI681468.1, W26301.1, AW150595.1, AA515499.1, AW771215.1, AI865546.1, AI701804.1, AW581686.1, AI086110.1, W51793.1, AI468490.1, Z40982.1, AA524294.1, R48292.1, AA235278.1, AA401894.1, AI951920.1, AA411825.1, W79461.1, AA773269.1, AW073072.1, AA234835.1, AA085172.1, D19722.1, M942310.1, AA618179.1, W22327.1, AW488834.1, AI843985.1, AI051267.1, H91657.1, F04676.1, F04857.1, AW660383.1, AW660325.1, AW590597.1, AW489945.1, AW456044.1, AW137933.1, M850275.1, M844940.1, AI838491.1, AI703271.1, AI692281.1, AI680928.1, AI123752.1, AA996267.1, AA770038.1, AA703627.1, AA683172.1, AA654126.1, D80530.1, D52575.1, R48394.1, F04620.1, F02435.1, W47361.1, AI176530.1, AA800188.1, AI926298.1, AI923001.1, AI858244.1, AI681789.1, AI524221.1, AI313224.1, AI250876.1, AI244045.1, AI198743.1, AI146789.1, AI128819.1, AA683568.1, AA633285.1, AA631580.1, AA225384.1, H18841.1, H15851.1, R46772.1, D20732.1, AW487979.1, AL354778.1, AL161644.2, AC008048.8, AC062010.2, AC018617.2, AC069147.2, AC009278.3, AC016884.4, AC010826.2, AL138827.3, AL157777.3, AP001023.1, AP000841.1, AP000813.1, AP000624.1, AC009133.5, AC023831.3, AC019152.4, AC009970.6, AC019151.2, AL121993.6, AL122010.2, AC063932.3, AC016526.3, AC016763.5, AC017080.4, AC018800.4, AC011920.2, AL355539.1, AP001486.1, AP000875.1, AC012600.4, AC012515.11, AC064800.2, AC068785.4, AC024677.3, AC010247.6, AC068443.1, AC027166.2, AC025238.3, AC013455.3, AC021934.3, AC012600.3, AC018758.1, AL354812.5, AL137855.2, AL133229.33, AL355492.2, AL353637.1, AP000812.1, AP000763.1, AC061705.3, AC010241.3, AC011372.4, AC027542.2, AC011927.3, AC011646.3, AC027151.1, AC013614.4, AC019037.2, AL157776.4, AL138891.5, AL138752.3, AL138824.3, AL137073.2, AC022696.3, AC025356.1, AL139154.3, AL354834.2, AL158169.1, AP001121.1, AP000741.1, AC023491.13, AC007174.3, AC011830.3, AC022165.3, AC026169.1, AC015478.3, AC022012.2, AC018502.4, AC019348.2, AC010732.3, AC018601.2, AL160270.3, AC044865.2, AC037461.1, AC027165.1, AC015894.2, AL136087.6, AC008630.3, AC012325.5, AC011607.4, AC015469.2, AL139226.14, AL161640.6, AL353701.1, AL159997.3, AC022915.2, AC010539.3, AC025138.2, AC026495.1, AC024930.3, AC021169.2, AC024283.2, AC007908.2, AL158155.2, AC027309.2, AC068518.1, AC020796.2, AC022858.3, AC016234.3, AC009989.6, AC022639.1, AC016276.2, AC017951.1, AC006514.6, AL133462.13, AL157700.2, AL133352.10, AL157858.1,
SEQ ID NO: 425
ZH036/T3

AF080158.1, AF031416.1, AF029684.1, AF115282.1, AF088910.1, AF026524.1, AC012446.2, AE003490.1, Z12841.1, AC011299.3, AC005288.1, AF064862.1, AF045449.1, AL163281.2, AI906358.1, AI906367.1, AA326115.1, AA128064.1, AA480228.1, AI913998.1, AA932082.1, W68756.1, AW299768.1, AW440835.1, AA622156.1, AI116314.1, AI336571.1, AA670553.1, AW107580.1, AW656805.1, AI207161.1, AU012191.1, AW023682.1, AC012902.1, AC034218.1, AL158191.3, AC012521.10, AC012600.4, AC036172.2, AC031982.2, AC067985.1, AC034197.2, AC044864.1, AC009789.2, AC026141.2, AC031064.1, AC026813.1, AC018703.5, AC012600.3, AC022185.1, AL135901.4,
SEQ ID NO: 426
ZH0610/T3

AB014592.1, Z81477.1, AC002076.1, U95737.1, NM_008515.1, AC004888.1, AC005913.1, AF045573.1, Z79605.1, Z93372.1, AL034345.3, AL096825.2, D14521.1, Z29967.1, U10413.1, U10411.1, AC024757.1, AE003723.1, AE003558.1, AC003044.1, AF147262.1, AC006052.5, AL163235.2, AL163672.1, U07562.1, AL133417.10, AL161505.2, Z30662.1, Z94160.1, AL031668.20, AL031778.1, AL121770.1, X97907.1, AP001690.1, AP000476.2, Z86105.1, AI819413.1, AI924382.1, AI285875.1, AI763421.1, AI873246.1, AW269559.1, AW576160.1, AW383436.1, AA292930.1, AI214572.1, AI283562.1, AA832360.1, AI924446.1, AW024483.1, AA872599.1, AA913675.1, AW166702.1, R43429.1, AI277020.1, M698939.1, AW504194.1, R45756.1, AA293060.1, AW382696.1, AI201468.1, M78303.1, AW382687.1, AL120220.1, AW825865.1, AW825841.1, AW050148.1, AW049090.1, AW532203.1, AW526348.1, AI710287.1, AI704527.1, AI227931.1, AW825521.1, AI549397.1, AW690407.1, AW700877.1, AW252080.1, AV200996.1, D73302.1, AW137945.1, AW006835.1, AI758397.1, M249177.1, AI144501.1, AA877636.1, AA514763.1, N75450.1, AC055116.2, AC024259.7, AC025881.2, AC025389.2, AC023074.2, AC016494.3, Z99775.8, Z81452.1, AC011603.10, AC009172.4, AC011474.2, AC027446.2, AC011197.3, AL138961.3, AL136316.3, AL353700.2, Z98857.36, AL021576.1, Z92819.1, AC069065.1, AC069198.1, AC036176.2, AC036129.2, AC015970.4, AC063973.5, AC009267.6, AC048379.2, AC064857.2, AC037469.2, AC012220.4, AC011334.2, AC011354.2, AC011356.3, AC027526.2, AC067965.1, AC021165.3, AC007256.2, AC026960.2, AC015497.3, AC011944.3, AC018403.4, AC027654.1, AC026390.1, AC022882.3, AC018935.4, AC021773.5, AC0J9111.3, AC009395.5, AC018826.3, AC022373.1, AC022846.2, AC023482.2, AC010042.4, AC022682.1, AC015977.3, AC018520.2, AC007812.5, AC018070.1, AC018100.1, AC016527.1, AC011624.4, AC004580.2, AC006738.1, AC005079.1, AC004394.1, AL137244.14, AL162712.5, AL157785.2, AJ239319.3, AL353781.2,
SEQ ID NO: 427
ZH0610/17

AB014592.1, AF019413.1, L09706.1, AP000502.1, AC003970.1, AF016683.1, AL162751.1, AB007650.1, X98806.1, AE003797.1, AC006019.2, AC004322.1, AL122058.19, Z81036.1, Z98754.1, AL031668.20, L23769.1, AE003773.1, AE003655.1, AE003564.1, AC004691.1, AF178650.1, AC005341.12, AF038609.2, AC006948.4, AF106564.1, AC003019.1, AC005723.1, AC005514.1, AC002366.1, AC004004.1, AL163298.2, AL117186.3, AL132862.1, Z99171.1, Z68161.1, AL132979.2, Z68001.1, AL035634.7, AL031316.2, U41034.1, AP001753.1, AB001523.1, AL120221.1, AA929046.1, AI041117.1, AI827377.1, AW593254.1, AA812962.1, AW024862.1, AA947740.1, AI246685.1, AI374810.1, AW276606.1, AI094081.1, AI348653.1, AI085257.1, AI381973.1, AI339534.1, AA447828.1, AI824989.1, N94582.1, H20695.1 H20694.1, AW027408.1, AI913744.1, AA837844.1, R50099.1, AW014667.1, R59085.1, AW001701.1, AI493568.1, H18604.1, H18603.1, H00470.1, AA224209.1, H00524.1, R43106.1, R64026.1, H60970.1, AA888554.1, T89733.1, R76292.1, T89639.1, AA678432.1, D29431.1, AI796304.1, T89831.1, AI581321.1, W85831.1, AW505495.1, T89913.1, AA749373.1, AI866382.1, D20992.1, M907559.1, AW806478.1, AI993026.1, T44317.1, T42219.1,

TABLE 1-continued

Sequence homologies (GenBank Accession Numbers)

AA369223.1, AW825334.1, AW529924.1, AW410376.1, AW325591.1, AA528786.1, AA404694.1, H87801.1, T83925.1, AL139040.4, AC022548.2, AC015513.1, AC010204.9, AC069231.1, AC023566.3, AC024564.2, AC023254.3, AL135912.3, AC025759.2, AC008588.4, AC026994.2, AC015631.3, AC023770.2, AC009905.10, AC022695.3, AC022299.6, AC021096.3, AC017056.3, AC006894.2, AL157947.2, AL133274.7, AL022285.6,
SEQ ID NO: 428
ZH067/T3

AC004985.2, AB040940.1, AK000661.1, Z98949.1, AL163288.2, AL022327.17, AP001743.1, AP001504.1, AF230667.1, AE003714.1, AF177535.1, L48177.1, AL163218.2, AL137665.1, AL022328.21, U80447.1, U31961.1, AP000455.4, AP000382.1, M33971.1, M81411.1, AL121388.1,R47793.1, AW656364.1, C03870.1, W42331.1, AA270244.1, AV053890.1, R48394.1, AW480347.1, AA524294.1, AW354814.1, W22327.1, AA982279.1, AA153449.1, W33419.1, AA085244.1, AW357644.1, AV096701.1, AW049843.1, I437.1, AW632605.1, AW464232.1, AW445542.1, AW431970.1, AW430227.1, AV239122.1, AW143188.1, AA336769.1, AA336495.1, T40522.1, AC027803.1, AL121908.11, AC024913.16, AC024044.2, AC013366.6, AC017042.5, AC068770.3, AC026332.2, AC009801.3, AC068561.1, AC009105.6, AC011124.3, AC026132.2, AC018953.5, AC027267.1, AC011814.2, AC007940.2, AC024446.2, AC022563.1, AC012254.3, AC020430.1, AC016121.2, AC015515.2, AL163512.7, ALL21780.3, AL137024.6, , AL139132.4,
SEQ ID NO: 429
ZH067/T7

AC004985.2, AB040940.1, AK000661.1, AL022314.1, AL008718.23, Z99943.1, NM_006695.1, AC002301.1, AF055026.1, AC003043.1, U93871.1, AL021327.1, AC006322.2, AL049749.2, AL023879.1, Z83733.1, NM_014400.1, AC004843.1, AC008000.7, AF120989.1, AF082889.1, AF072246.1, AC005394.1, AC005173.1, Z99755.1, AL022153.1, AJ223603.2, AC004386.1, AC002418.1, AL009182.17, AL049565.3, Z83843.1, Z97205.1, AC008038.1, AD001527.1, AF165142.1, AC007011.1, AC005831.1, AC004962.1, AF064860.1, AC002420.1, AC002984.1, AL163280.2, AL096714.1, AL137294.1, AL049814.6, Z70289.1, AL008583.1, AL035455.29, Z22801.1, Z22787.1, AK000120.1, AC007324.55, AC009288.13, AC007708.13, AC010491.3, AC011506.3, AC000134.14, AC004812.1, AC006116.1, AF064858.1, AC004775.1, AF041381.1, AL163278.2, AL109827.8, AL121749.13, AL133500.2, Z83851.17, AL035659.22, AL049759.10, Z83844.5, AL023755.5, AL035086.12, Z97053.1, Y12508.1, AP000529.1, D86957.1, AC008033.8, AC003010.1, AC007191.1, AL031658.11, AC007040.2, AC006312.8, AC006952.6, AC004687.1, AL138996.2, AL049636.21, AL121389.1, AI675618.1, M953917.1, M670867.1, AI420775.1, AI199226.1, AA570572.1, AA577683.1, AI678864.1, AI801384.1, AA599079.1, AI673355.1, AI743710.1, AI473720.1, AW168045.1, AI973140.1, AI750437.1, AI681468.1, AA918762.1, W78002.1, W26301.1, AW150595.1, AA515499.1, AW771215.1, AI701804.1, AI865546.1, AI086110.1, AW581686.1, W51793.1, Z40982.1, AI468490.1, AA234835.1, AA.524294.1, R48292.1, AA235278.1, AA401894.1, M951920.1, W79461.1, AA411825.1, AW073072.1, AA773269.1, AI942310.1, AA085172.1, D19722.1, AA618179.1, W22327.1, R48394.1, AW488834.1, AI843985.1, AI051267.1, H91657.1, P04676.1, F04857.1, AW785534.1, AW731989.1, AW660383.1, AW660325.1, AW590597.1, AW489945.1, AW456044.1, AW137933.1, AI850275.1, AI844940.1, AI838491.1, AI703271.1, AI692281.1, AI680928.1, AI352391.1, AI123752.1, AA996267.1, AA770038.1, AC703627.1, AA683172.1, AA654126.1, AA452958.1, C21254.1, D80530.1, D52575.1, F10154.1, F04620.1, F02435.1, Z40856.1, AA037243.1, W47361.1, AI176530.1, AA800188.1, AI926298.1, AI923001.1, AI858244.1, AI681789.1, AI313224.1, AI244045.1, AI198743.1, AI128819.1, AA631580.1, AA568435.1, AA225384.1, R46772.1, AW487979.1, AL354778.1, AL161644.2, AC008048.8, AC062010.2, AC018617.2, AC069147.2, AC009278.3, AC016884.4, AC010826.2, AL138827.3, AL157777.3, AP001023.1, AP000841.1, AP000815.1, AP000624.1, AC009133.5, AC023831.3, AC019152.4, AC009970.6, AC019151.2, AL121993.6, AL122010.2, AC063932.3, AC016526.3, AC016763.5, AC017080.4, AC018800.4, AC011920.4, AL355539.1, AP001486.1, AP000875.1, AC012600.4, AC012515.11, AC064800.2, AC068785.4, AC024677.3, AC010247.6, AC068443.1, AC027166.2, AC025238.3, AC013455.3, AC013682.3, AC021934.3, AC012600.3, AC018758.1, AL354812.5, AL138847.3, AL137855.2, AL133229.33, AL355492.2, AL353637.1, AP001590.1, AP000763.1, AZ061705.3, AC068683.1, AC010241.3, AC027542.2, AC011927.3, AC011646.3, AC027151.1, AC015855.4, AC013614.4, AC019037.2, AL157776.4, AL138752.3, AL138824.3, AP001007.1, AC022696.3, AC025356.1, AP121897.1, AL356267.2, AL354834.2, AL160314.2, AL139244.2, AL158169.1, AP000741.1, AC023491.13, AC007174.3, AC013830.3, AC008655.5, AC022165.3, AC018751.22, AC026169.1, AC022012.2, AC018502.4, AC019348.2, AC010732.3, AC018601.2, AL160270.3, AJ239320.2, AC037461.1, AC015894.2, AL136087.6, AC008630.3, AC031607.4, AC015469.2, AL139226.14, AL161640.6,
SEQ ID NO: 430
ZH1110/T3

NM_015642.1, AL050276.1, AF194030.1, AF185576.1, AC008843.5, NM_001166.1, U37547.1, L49431.1, AC013738.4, NM_006585.1, AC006972.2, AC006384.2, AC004828.2, AC007052.4, AF077215.1, AC005144.1, AL163249.2, AL163243.2, AL109752.13, AL031283.26, AJ251713.1, A3251712.1, AL035415.22, Z68332.1, AC035073.4, AL130503.1, D42052.1, AP001698.1, AP001601.1, D13627.1, AA578163.1, AA069836.1, AW237166.1, H85064.1, AW502748.1, AW613145.1, AW106649.1, AI828036.1, AI221632.1, AA464297.1, AI151799.1, AW729812.1, AW372984.1, AW372983.1, AW235267.1, AI032501.1, AA702174.1, AA354613.1, AA281621.1, AA034048.1, W80497.1, W17275.1, T73134.1, AW731100.1, AW730874.1, AW730644.1, AW730370.1, AW728863.1, AW728739.1, AW728717.1, AW727809.1, AW673083.1, AW618417.1, AW247278.1, AW213355.1, AI648841.1, AA984168.1, AA385412.1, AA347604.1, f188667.1, AC069063.1, AC026560.4, AC027493.2, AC055739.2, AC020896.4, AC063979.1, AC025358.3, AC036131.2, AC041009.1, AC034154.1, AC027790.1, AC012056.3, AC024606.2, AC021712.3, AC022736.2, AL161444.2, AP001959.1, AC046138.4, AC022293.9, AC032022.2, AC068656.1, AC025763.2, AC022894.2, AC025897.2, AC019309.3, AC021754.3, AC013330.5, AC011171.3, AC016135.1, AL136990.14, AP001830.1, AP001167.1, AP000942.2, AC061973.2, AC064862.2, AC040597.2, AC025767.3, AC202030.4, AC008839.4, AC036127.2, AC037456.2, AC022218.4, AC019176.3, AC034167.2, AC026542.2, AC015992.3, AC021506.3, AC021005.2, AC025891.2, AC011853.3, AC011848.5, AC012571.3, AC025009.2, AC009899.5, AC020565.4, AC013642.5, AC025346.1, AC021141.2, AC015950.2, AC017056.3, AC021047.2, AC019648.1, AC007432.7, AC009437.1, AP129075.1, AL356137.2, AL356322.1, AL162716.4, AL109751.18, AL160265.4, AL137144.4, AL355386.1, AL354778.1, AL137074.4, AL157365.3, AP002083.1, AP002013.1, AP001841.1, AP001569.1, AP001365.1, AP001356.1,

TABLE 1-continued

Sequence homologies (GenBank Accession Numbers)

SEQ ID NO: 431
ZH1110/T1

NM_015642.1, AL050276.1, AP194030.1, AF185576.1, AC008372.6, AC005874.3, AC007766.1, AF134471.1, D88148.1,
AE003835.1, AC007225.2, AC005214.1, AL133258.16, AL163225.2, AL034559.3, AP001680.1, AP003138.2,
AA834935.1, AW293260.1, M798849.1, AI240155.1, AA083812.3, N26227.1, AI809178.1, AA930334.1, AA828063.1,
AA943003.1, AW108541.1, M551088.1, AI626969.1, N71750.1, AI445139.1, N99462.1, AV028027.1, AI809910.1,
AA613636.1, AV137484.1, AV329304.1, AV330564.1, AV329353.1, AI610886.1, T12777.1, AW115543.1, 3193225.1,
H02904.1, AW772943.1, AW601219.1, AW483664.1, AW250685.1, AW249227.1, C77465.1, AC068938.1, AC068072.7,
AC025676.2, AC021032.3, AC068659.1, AC036186.2, AC010287.5, AC009164.3, AC009130.5, AC009093.5,
AC008758.3, AC027250.2, AC024721.4, AC007615.3, AC021792.2, AC025394.2, AC012111.3, AC009270.2,
AC015958.3, AC017038.5, AC023980.2, AC010583.3, AC022023.2, AC018792.2, AC011279.1, AL157833.5,
AL136172.14, AL355594.3, AL135903.2, AL033383.25, AL158014.4, AL160280.2, AL157827.3, AL137848.1,
AL138831.2, AL157883.2, AL136309.3, AL134461.2, AP001780.1, AP000853.1, AP000580.2, AC012520.8, AC046140.4,
AC026763.5, AC048337.4, AC067852.1, AC027810.2, AC021443.5, AC022715.2, AC021369.3, AC025311.2,
AC019313.3, AC024619.2, AC010687.2, AC020372.1, AC012281.1, AC007896.1, AP000874.1, AIP000562.2,

SEQ ID NO: 432
ZH118/T3

NM_001278.1, AF080157.1, AF009225.1, AF012890.1, U22512.1, NM_0077001 U12473.1, AC012347.7, AE003769.1,
AF227841.1, AC009888.1, AL132641.2, AL049775.2, AL132986.2, AF127936.2, AC010685.3, AC006730.1,
AE003493.1, ACZ009464.7, AC007377.3, AF130351.1, AC007785.1, AL355094.2, AL163257.2, AL163207.2,
AL132853.1, ALL21808.2, AL135745.2, AL121774.3, AL031768.9, AL096710.8, AL078473.2, U29521.1, U29450.1,
AP001712.1, AP000213.1, AP000031.1, AP000255.1, AP000I35.1, AW611010.1, AW822592.1, AA512576.1,
AW159773.1, AW159313.1, AA721189.1, AV400040.1, AI553167.1, AU004118.1, AA518188.1, AA109551.1, R03450.1,
AW769650.1, AW497368.1, AW496881.1, AW485684.1, AW344422.1, AT001962.1, AI241905.1, AI200843.1,
AI037034.1, AA704752.1, AA660505.1, AC018783.3, AL138921.6, AC026883.2, AL155168.5, AC018351.8,
AC015797.2, AC027704.2, AC027438.2, AC024130.3, AC012204.3, AL050344.25, AL355517.2, AP001963.1,
AP001816.1, AC041002.1, AC013259.3, AC021846.3, AC012202.2, AC002489.3, AL133313.1, AC016962.8,
AC0619782, AC026270.2, AC068854.1, AC068368.1, AC024334.2, AC025661.2, AC0I0941.3, AC013497.4,
AC021403.4, AC011755.3, AC022238.3, AC010129.2, AC013189.1, AC004071.1, AL353645.2, AL139216.4,
AL136362.2, AL35 6094.1, AL3 53764.1, AL139020.1,

SEQ ID NO: 433
ZH118/T7

AF080157.1, AL133012.1, NM_007700.1, U12473.1, AC005831.1, AB019534.1, AC008164.3, AC004801.1,
AL035078.32, AL031733.3, AC003683.1, Z97632.1, AL032654.1, AJ235272.1, AC009498.3, AC007246.3, U41538.1,
AL136418.2, AL110487.1, AL139054.1, X69484.1, AC008417.3, AC004125.1, AC005230.1, AF039082.1, U50529.1,
AL033547.7, AL031798.1, AL022398.1, AL109613.11, AL009050.9, U80441.1, Z96104.1, AC009424.2, AC006032.2,
AC006299.1, AL133512.10, AW780178.1, AI763039.1, AW271579.1, AW237549.1, AA743087.1, AI148163.1,
AI306448.1, W38922.1, AA047462.1, AI082138.1, AA398684.1, AW006992.1, AI300129.1, AI968640.1, AW009015.1,
AI311794.1, N94750.1, AW298757.1, AI261452.1, H04646.1, N49180.1, AI039207.1, AA759032.1, R37348.1, N29132.1,
AA747405.1, AI953544.1, AI991366.1, H02318.1, AA744487.1, R22181.1, R63099.1, AA868823.1, R26178.1, R63149.1,
R26420.1, AI630705.1, T10670.1, R22180.1, AI829429.1, AI410474.1, AI408983.1, AW701142.1, AI225339.1,
AA276153.1, AA204533.1, AA217073.1, AI324361.1, AA152883.1, AI528668.1, AA183300.1, AA289029.1,
AW823505.1, AA945959.1, AA084869.1, AW785016.1, AA617021.1, AW552155.1, AI234361.1, AA512576.1,
AV225898.1, AA818928.1, AI505683.1, AA437895.1, AV380532.1, AV331321.1, AV307290.1, AU045682.1,
AU044796.1, AU044266.1, AI256658.1, AAO85015.1, AA070210.1, AV375846.1, AV302964.1, AV126809.1, W39998.1,
AV370274.1, AV314653.1, AV107765.1, AV068797.1, AA087827.1, AA656892.1, AV314950.1, AV068813.1,
AW775907.1, M930381.1, AI718289.1, AA778631.1, AA403202.1, AL138921.6, AC026424.2, AC008587.4,
AC012213.3, AC044811.2, AC009485.2, AC027548.2, AC018718.4, AC010987.4, AL138970.6, AC009857.2,
AC011771.3, AC010952.3, AC022002.2, AC023451.2, AC010963.2, AC010517.1, AL157688.3, AC012592.5,
AC021101.3, AC001233.1, Z98867.1, AC051652.2, AC024126.1, AC024123.1, AC023019.1, AL139353.1, AC055786.2,
AC010600.3, AC009611.3, AL138762.5, AC068981.1, AC011086.4, AC040919.1, AC019064.3, AC015476.3,
AC040975.2, AC032024.2, AC021568.4, A0022065.2, AC016386.3, AC023202.2, AC006718.1, AL121957.7,
AL137780.2, AL109947.5, AL139806.3, AL139391.2, AP001981.1,

SEQ ID NO: 434
ZH1214/T3

D43948.1, X92474.1, AI251130.1, AL022397.1, AC007462.2, AF015750.1, AB018116.1, NM_016121.1, AC012262.14,
AF155110.1, AF126811.1, AE001705.1, U46575.1, U97404.1, AL133485.1, AL034561.4, Z98255.1, Z35331.1, U41510.1,
D78638.1, AW875503.1, AV262782.1, AI680593.1, AA330998.1, AA161253.1, AW875430.1, AI770288.1, R76393.1,
AW779977.1, AW636618.1, AW572796.1, AW340052.1, AW264564.1, AW264231.1, AW264326.1, AW195137.1,
AW193971.1, AW152577.1, AW150295.1, AW035488.1, AW050930.1, AW005644.1, AW001803.1,
AI992833.1, AI992162.1, AI984556.1, AI967314.1, AI907040.1, AL037274.1, AI765832.1, AI686848.1, AL048814.1,
AI421765.1, AI398575.1, AI393364.1, AI339232.1, AI283161.1, AI277807.1, AU032822.1, AI018124.1, AA978299.1,
AA936410.1, AA929004.1, AA858164.1, AA780119.1, AA772740.1, AA770301.1, AA448160.1, W81099.1, W81046.1,
W58357.1, W45601.1, N41386.1, D57384.1, T30120.1, AC055841.2, AC020704.3, AL157363.3, AL355599.2,
AC009232.2, AC044855.2, AC012314.5, AC022166.4, AC016238.2, AC069065.1, AC069035.1, AC018827.4,
AC015565.3, AF189005.1,

SEQ ID NO: 435
ZH1214/T7

, X92474.1, D43948.1, AJ251130.1, AF061744.1, AF001863.1, AF102850.1, U48696.1, AF045432.1, A.1243486.1,
Y16849.1, A3243656.1, U39066.1, U37573.1, Y16299.1, X99058.1, X99060.1, X99051.1, X99057.1, X99056.1,
X99052.1, Z97178.1, Y16851.1, AF033096.1, U48697.1, AF011573.1, X99055.1, AJ270223.1, X99054.1, X99053.1,
AF128444.1, Y17148.1, Y07542.1, AF224771.1, AF184239.1, U23715.1, AL161559.2, AL031326.1, AC000095.3,

TABLE 1-continued

Sequence homologies (GenBank Accession Numbers)

AC002522.2, AC004461.3, L77570.1, AL031430.1, AL109939.13, AC000L21.1, AF146603.1, AE003700.1, AC000092.1, AC004099.1, AC004231.1, U82964.1, AL031277.1, U30368.1, X73502.1, X73501.1, AW374979.1, R14180.1, AW407477.1, AW176568.1, AW239387.1, W27586.1, AA805103.1, AA767900.1, Z20910.1, AA094395.1, AA568734.1, AA299590.1, Z19789.1, AI396976.1, AW409741.1, AI857031.1, AI857046.1, AI816693.1, AI816668.1, AI816651.1, AI815345.1, AI816702.1, AI816701.1, AI816700.1, AI816699.1, AI816697.1, AI816696.1, AI816695.1, AI816694.1, AI816692.1, AI816690.1, M816689.1, AI816688.1, AI816667.1, AI816664.1, AI816663.1, AI816662.1, AI816661.1, AI816660.1, AI816659.1, AI816658.1, AI816657.1, AI816656.1, AI816655.1, AI816654.1, AI816653.1, AI816652.1, AI816650.1, AI816649.1, AI816648.1, AI816647.1, AI816646.1, AI816645.1, AI816644.1, AI816643.1, AI816641.1, AI816640.1, AI816639.1, AI816638.1, AI815377.1, AI815376.1, AI815375.1, AI815374.1, AI815373.1, AI815371.1, AI815370.1, AI815369.1, AI815368.1, AI815367.1, AI815366.1, AI815365.1, AI815363.1, AI815362.1, AI815361.1, AI815360.1, AI815347.1, AI815344.1, AI815343.1, AI657485.1, AA933356.1, AA933350.1, AA933216.1, AA933125.1, AA933095.1, AA933094.1, AA660699.1, N83963.1, AI815364.1, AI816698.1, AI516642.1, AI446849.1, AI353568.1, AA933275.1, AA933111.1, AA933353.1, AA933184.1, AW455598.1, AI617314.1, AI354018.1, AI353756.1, AC012054.1, AC018448.8, AC041023.2, AC068800.3, AC009452.9, AC026031.3, AC024663.3, AC068617.1, AC026659.3, AC027191.2, AC027065.2, AC025309.2, AC026522.1, AC024628.2, AC010187.6, AC023800.3, AC017028.5, AC068493.3, AC037481.2, AC023859.2, AC022133.3, AC010218.4, AC008680.3, AC008665.3, AC011500.5, AC027735.2, AC009786.2, AC026990.2, AC025484.2, AC022357.3, AC022705.3, AC011226.3, AC011795.4, AC017007.5, AC020586.2, AC015529.3, AC021694.2, AC013786.2, AC016820.2, AC022281.1, AC014336.1, AC016381.1, AL137003.2, AL159970.7, AL138890.3, AL139004.3, AL355839.1, AL355497.1, AL161447.4, AL138795.1, AP001947.1, AP000812.1, AP000665.1,
SEQ ID NO: 436
ZH1217/T7

M14660.1, AC006437.4, AC006560.8, AF091596.1, AC000348.2, AC016951.9, AC010252.3, AC008854.3, AC007878.2, AC007178.5, AE003561.1, AC006024.1, AC007463.3, AC002330.1, AFI31858.1, AC004352.1, AC001645.1, AL161541.2, AF000198.1, AL138649.1, Z70756.1, AL132965.1, AL049745.9, Z97338.2, U00063.1, AK001541.1, AK001417.1, AP000386.1, AP000373.1, AB016873.1, AB012244.1, AC005155.1, AC007200.1, AC006952.6, AC005610.1, AL096712.20, Y17293.1, AP000884.1, AA131041.1, AI458848.1, AI740602.1, AI140291.1, AI620542.1, AI338018.1, N63988.1, AI373569.1, AI446658.1, N51262.1, AA975115.1, AA134105.1, AA810945.1, AA854597.1, AW337373.1, AA056431.1, AI301531.1, AI261334.1, AA866128.1, AW272913.1, AI469715.1, AI080333.1, AA976884.1, AI770049.1, AA516150.1, AA484050.1, AAR30252.1, AA765174.1, AI924290.1, AA811287.1, AV383770.1, AW232841.1, AW190734.1, AW725886.1, AA847944.1, AA188141.1, R84767.1, AW623261.1, AW443728.1, AW316855.1, AW241933.1, AW034720.1, AI985531.1, AI978628.1, AI956080.1, AI897778.1, AL043557.1, AL043510.1, AI698209.1, AI679174.1, AI611067.1, AI572570.1, AI570861.1, AI552591.1, AI527468.1, AA875645.1, AI367193.1, AI263737.1, M247560.1, AI168145.1, AI120817.1, AI040092.1, AA780998.1, AA725576.1, AA723350.1, AA652386.1, AA493515.1, AA486562.1, AA316491.1, AA040803.1, W23971.1, W05624.1, N58119.1, N38766.1, H85097.1, H39883.1, AL353751.3, AC021882.3, AL136526.15, AC068012.1, AC019810.4, AL021148.1, AC021057.4, AC051628.10, AC008613.4, AC009196.11, AC010816.3, AC010949.2, AC008677.4, AC062038.1, AC068395.1, A0027463.2, AC012221.3, AC027078.2, AL162501.2, AP001531.1, AP000920.1,
SEQ ID NO: 437
ZH1217/T3

M14660.1, X77259.1, NM_001549.1, U52513.1, AF083470.1, AF026939.1, NM_008332.1, U43085.1, 577713.1, X07557.1, M146591 NM_010501.1, U43086.1, L32974.1 NM_012420.1, U34605.1, AE003505.1, NM_005691.1, AF061297.1, AL109939.13, AP116685.1, AC009479.3, AC009241.3, AC008567.4, AC007969.3, AC010125.3, AC016939 8 NM_012768.1, AC002381.1, NM_001548.1, AC002565.1, AC004834.2, AC007759.1, AC005694.3, AC004765.2, AC005527.3, AC006050.1, AC006134.1, AC004584.1, AC005195.1, AL163237.2, ALL21931.10, AC000388.1, AL031670.6, AL079304.2, AL132855.2, AL137669.1, AL049795.20, AL133396.1, U69569.1, AL023879.1, AL049794.13, AL031388.1, Y18000.1, AP001692.1, M24594.1, X03557.1, AP001341.1, X94359.1, M69118.1, M16724.1, AA148160.1, AA054658.1, AA131155.1, AA135032.1, W74319.1, AW379473.1, AA200841.1, AW390730.1, AW378603.1, AA727519.1, AW763283.1, AA087306.1, AW378605.1, M77945.1, AA700017.1, AI928930.1, AW579659.1, AW390720.1, W39498.1, AW163828.1, AI821192.1, AI413442.1, AI133441.1, AH14693.1, AA619629.1, AA506010.1, AA249243.1, AA209431.1, AA209430.1, L26678.1, AL353751.3, AC016791.4, AC060826.2, AL353146.2, AL355342.2, AC037423.2, AC013781.3, AC027175.2, AC024459.2, AC016154.4, AC010204.9, AC064799.2, AC016526.3, AC021601.3, AC025854.2, AC016435.3, AC012186.3, AC024432.2, AC013432.3, AC019768.1, AC011920.2, AL355604.2, AL354870.1, AL162393.2, AC012520.8, AC011314.6, AC067724.3, AC046140.4, AC026763.5, AC051660.3, AC021032.3, AC027195.2, AC025467.3, AC027130.2, AC068506.1, AC027438.2, AC013734.3, AC009481.3, AC017014.3, AC009712.3, AC027523.2, AC026269.2, AC024130.3, AC024131.3, AC022737.2, AC026026.3, AC034194.1, AC016419.3, AC019058.3, AC012111.3, AC022020.3, AC021884.2, AC011774.4, AC022826.3, AC013587.4, AC018881.4, AC020644.2, AC015912.3, AC024015.1, AC018979.4, AC018980.3, AC009985.5, AC012493.3, AC013721.3, AC012553.3, AC013476.3, AC016048.1, A0015650.1, AC002317.1, AL136987.2, AL355579.3, AL157713.4, AL353793.2, AC002345.1, AL354981.1, AL354917.1, AL354833.1, AL160252.3, AL161723.3, AL158158.4, AL158011.1, AL137128.1, AP001873.1, AP001848.1, AP001637.1, AP000598.2
SEQ ID NO: 438
ZH1222/T3

NM_004506.2, M652171 NM_008297.1, X61754.1, AF172640.1, Z99129.1, AF045615.1, AF045618.1, L06125.1, AF045617.1, AF045616.1, AF172641.1, L26924.1, AF045619.1, X61753.1, NM_005526.1, X55347.1, M64673.1, AF045620.1, AL035451.5, AC009227.3, AC007364.2, AC007193.1, AC007124.1, AC004812.1, U49511.1, AL163242.2, L11868.1, AL035698.12, AL050324.5, Z82200.1, AJ006397.1, Z83860.1, AP001697.1, AP001601.1, L06098.1, AE002550.2, AE002206.1, AF124349.1, AE001616.1, AC005547.1, AF075603.1, AL132641.2, AL139078.2, AL122003.17, AL033517.1, Z49274.1, L47649.1, D90910.1, AB018115.1, Z46953.1, M12897.1, AW352398.1, AL035756.2, AA362830.1, AL044736.1, AA888406.1, AA354787.1, AW767522.1, AI002480.1, AI324484.1, AW640883.1, AW169960.1, AW137844.1, AW135472.1, AW054829.1, AW016463.1, AW007349.1, AI934773.1, AI895934.1, AI863994.1, AI809542.1, AI703424.1, AI700961.1, AI692361.1, AI651222.1, AI628965.1, AI521804.1, AI393937.1, AI042312.1, AI055366.1, AA118488.1, AI295219.1, AV386944.1, AI373558.1, AI372231.1, AW854061.1,

TABLE 1-continued

Sequence homologies (GenBank Accession Numbers)

AW255279.1, AW233008.1, AI900223.1, AI881242.1, AV082943.1, AI634255.1, C95479.1, AI477508.1, AA928989.1,
AA913874.1, AA913417.1, AA811007.1, AA807625.1, AA771801.1, AA743736.1, AA723901.1, H73197.1, R94578.1,
T93779.1, AC022207.2, AL121954.4, AL109916.3, AL138961.3, AC013581.4, AC062011.2, AC063945.3, AC009817.3,
AC058817.3, AC022417.3, AC008473.3, AC023337.3, AC027697.2, AC019198.2, AC016173.2, AC007449.2,
AC025891.2, AC018773.2, AC012564.2, AL138775.5, AL122002.14, AL356311.1, AL355302.3, AL079336.13,
AL137859.3, AL355375.3, AL133330.7, AL162457.3, AP001997.1, AP001984.1, AC011471.5, AC010614.4,
AC067980.1, AC067916.1, AC005038.2, AC009612.3, AC027039.2, AC026082.3, AC021433.3, AC018791.3,
AC024596.3, AC024037.2, AC021777.3, AC009792.4, AC026113.4, AC022898.3, AC025733.1, AC013768.4,
AC019348.2, AC010732.3, AC014147.1, AF178220.1, AC007194.1, AC005051.1, AL353729.2, AL136959.2,
AL157786.2, AL136302.6
SEQ ID NO: 439
ZH1222/T7

Z99129.1, NM_004506.2, M65217.1, NM_008297.1, AF045627.1, X61754.1, AF172640.1, AL163912.1, Z68160.1,
L41499.1, U40424.1, D17366.1, AC011809.2, AC008126.9, AC000104.1, AL133216.10, Z92844.1, AC002329.2,
AE003811.1, AE003525.1, AE003517.1, AE003486.1, AE002786.1, AC018748.3, AF102707.1, Z83318.1, AI923911.1,
AI990935.1, AI203377.1, AI056677.1, AW269952.1, AI989487.1, AI472020.1, AI524322.1, AI700694.1, AI561266.1,
AI979106.1, AW008963.1, AW468756.1, AW183922.1, AI688920.1, AA905319.1, AI690727.1, AA707596.1,
AI499774.1, AA551748.1, AA551757.1, M536850.1, AA969316.1, AI480249.1, AA253434.1, AA832045.1, AI270358.1,
AI810705.1, AI433107.1, AA651949.1, AA969392.1, N39221.1, AA868883.1, AI142644.1, AL035757.1, AA136344.1,
AI453040.1, AA860985.1, AA913304.1, AA913486.1, AW468554.1, R39144.1, AA815117.1, AI473089.1, H24055.1,
AI539466.1, AA971072.1, T53314.1, H72024.1, R46149.1, D53854.1, D52415.1, AW028964.1, H72025.1, AA250730.1,
D52616.1, D52419.1, H14792.1, F04785.1, T29491.1, N46665.1, C20787.1, T53313.1, AW142847.1, AI740594.1,
AI230246.1, AI167251.1, AA944812.1, AI661205.1, AA268498.1, AV259149.1, AA832774.1, AI962803.1, AI556468.1,
AA818911.1, AI170959.1, AI010919.1, AI102092.1, AL121954.4, AL109916.3, AC027000.2, AC068022.1, AC027082.2,
AC024345.2, AL049180.3, AC011602.6, AC027648.6, AC025854.2, AC027355.1, AC022387.2, AC022480.4,
AC025302.2, AC009754.3, AC009816.5, AC024260.1, AC011683.3, AC010660.4, AL121954.4, AL109916.3,
AC027000.2, AC068022.1, AC027082.2, AC024345.2, AL049180.3, AC011602.6, AC027648.6, AC025854.2,
AC027355.1, AC022387.2, AC022480.4, AC025302.2, AC009754.3, AC009816.5, AC024260.1, AC011683.3,
AC010660.4
SEQ ID NO: 440
ZH1233/T3

AB006198.1, Y14314.1, AB014722.1, AB014721.1, AF129931.1, AF147725.1, AC007915.3, AF028338.1, L20095.1,
L20680.1, NM_015933.1, AC011462.4, AE003765.1, AC000029.17, AF161448.1, AF077202.1, U39402.1, AC004196.1,
U67478.1, AL163816.1, Z97832.11, AL049853.1, AL112418.1, AL021930.1, L09190.1, AK001152.1, AB023212.1,
M15100.1, AB017022.1, W27222.1, AW402760.1, AL047890.1, AI594593.1, AW820827.1, AA607769.1, AI120962.1,
AI509410.1, AI908693.1, AW393484.1, AW652595.1, AI964608.1, AA979854.1, AA979772.1, AI661459.1, M642054.1,
AJ228935.1, AA751847.1, AW758324.1, AI827037.1, AV417239.1, AW674436.1, AW615491.1, AW245981.1,
AW074946.1, AW006944.1, AI924762.1, AI880663.1, AI880658.1, AI709253.1, AI708293.1, AI708235.1, P33596.1,
F30411.1, P28809.1, F28190.1, F27897.1, AI666115.1, AI570650.1, AI459983.1, AI418553.1, AI370584.1, AI364309.1,
AI339191.1, AI333234.1, AI290693.1, AI090805.1, AA910393.1, AA563619.1, AA364686.1, AA321138.1, AA280277.1,
AA279851.1, AA229404.1, AA151350.1, AA149268.1, AA134303.1, AA082333.1, AA046848.1, AA026455.1, W95678.1,
W76586.1, W51757.1, W04465.1, N84053.1, N80509.1, N78206.1, N76058.1, R07233.1, T91349.1, T80989.1,
AP001201.4, AP000592.2, AP001191.1, AP000586.2, AC008683.4, AC018996.3, AC046141.3, AC068951.1,
AC022120.4, AC008405.3, AC008658.2, AC011069.6, AC013189.1, AC055744.2, AC068667.3, AC027309.2,
A0027307.3, AC022091.3, AC010377.4, AC008453.4, AC008450.3, AC064317.1, AC064056.1, AC052499.1,
AC044355.1, AC045178.1, AC041917.1, AC040463.1, AC034640.1, AC028038.1, AC021328.3, AC021286.3,
AC007903.2, AC026184.1, AC019127.4, AC018734.2, AC011233.2, AC023950.2, AC010899.3, AC015903.1,
AC014411.1, AC018045.1, AC006579.3, AL136136.2, AL136119.3, AL109955.13, AL135939.9, AL133282.13,
AL133284.12, AL032818.2
SEQ ID NO: 441
ZH1235/T3

AJ236885.1, L04282.1, AF039019.1, U30381.1, NM_011749.1, X98096.1, AI001165.1, U80078.1, AL133244.1,
AL121656.2, AC008125.9, AL049648.6, AC007444.1, AE003754.1, AC005552.1, AI006687.1, AL038916.1, AI158501.1,
AA967471.1, AW261045.1, AW425025.1, AI093969.1, AW667700.1, AW619431.1, AW619430.1, AW359900.1,
AA911993.1, D86150.1, AC019289.3, AC032043.1, AC026618.1, AC020598.3, AC019180.4, AC009770.4, AC023077.3,
AC040911.1, AC034145.1, AC023199.2, AC027362.1, AC0262432, AL139189.4, AL354939.3, AL354985.2,
AC069141.1, AC020609.4, AC016965.6, AC019074.3, AC026116.7, AC026441.2, AC024588.2, AC022113.4,
AC016648.4, AC010308.4, AC022554.2, AC023560.2, AC021219.2, AC020787.2, AC007825.5, AC012075.3,
AC016484.1, AC016965.5, AC019694.1, AC010120.4, AC012550.1, AL353575.3, AP001972.1
SEQ ID NO: 442
ZH1235/T7

AF039019.1, AJ236885.1, U30381.1 NM_011749.1, U80078.1, X98096.1, AJ001165.1, U96633.1, L04282.1,
AE003673.1, AF214658.1, AE001574.1, AC005379.1, AC002512.1, AC005817.7, AC004005.2, AC003063.7,
AF181967.1, U90222.1, AP113957.1, AC004189.1, U97191.1, Z81052.1, AI245414.1, A.1012638.1, AJ012636.1,
AP000517.1, AB023055.1, AB023054.1, AI263859.1, AA563588.1, AI056295.1, AA287619.1, AI743361.1, AW779476.1,
AI384073.1, AI382374.1, AW051393.1, AA613057.1, AA943882.1, AI848462.1, AI323627.1, AW272463.1,
AW772534.1, H12745.1, AW823563.1, AAI10786.1, AI467973.1, AI283469.1, AI077636.1, AI003273.1, AA622568.1,
AA552124.1, AA192099.1, AW732203.1, AI955302.1, AI955293.1, AI696880.1, AI283452.1, H70711.1, AA764105.1,
AI393951.1, H12746.1, AI864852.1, AW214414.1, AI589987.1, AA631115.1, C06563.1, AI202723.1, AI030160.1,
AA661593.1, AA414802.1, T81259.1, AI806680.1, AW229224.1, AV147450.1, AI502057.1, AI318282.1, N27696.1,
AI092457.1, AV250724.1, AI179647.1, AI591356.1, AW313771.1, AA811939.1, AA219846.1, AW003751.1, AI823800.1,
AI819198.1, AA887801.1, AW850285.1, AW850147.1, AW805474.1, M729407.1, AI729074.1, AI115405.1,
AA793995.1, W43508.1, AA416406.1, AA041084.1, Z34722.1, T02803.1, AC019289.3, AC055752.5, AC026618.1,

TABLE 1-continued

Sequence homologies (GenBank Accession Numbers)

AC068071.3, AC009282.2, AC023583.2, AC020313.1, AL133266.4, AL049597.28, AL158137.1, AC022334.11,
AC025069.3, AC015840.2, AC022401.2, AC018966.3, AC023396.2, AC022526.4, AC023271.3, AC026396.1,
AC022534.4, AC011737.3, AC009703.2, AL355532.4, AL157823.3, AL109917.1, AP001257.1
SEQ ID NO: 443
ZH1239/T3

NM_006431.1, AF026166.1, AF026293.1, AB041570.1, NM_007636.1, Z31553.1, U91327.1, AB022156.1, U25632.1,
AE003446.1, AL031174.1, Z69239.1, Z98547.1, NC_001142.1, L47993.1, Z49564.1, NM_014680.1, AC007030.3,
AF077407.1, AC005726.1, AC004807.1, AL157421.1, D43947.1, U46030.1, AC004768.1, U67606.1, AL021939.1,
U21308.1, AF025703.1, AL032653.1, AL049823.14, AL031268.1, AL096773.6, U15667.1, AB025613.1, AB015478.1,
AB008158.1, AL037847.1, AA314410.1, AL037869.1, AA307298.1, AW403677.1, AA308098.1, AA188046.1,
AA242864.1, AI027493.1, AA081834.1, W05515.1, AA160646.1, W45121.1, AA313512.1, AA232345.1, AA361372.1,
AA353331.1, AA224141.1, AA053093.1, AA329489.1, AA332992.1, AA295347.1, AA357480.1, AA852740.1,
AW673301.1, AA319426.1, AA312375.1, AW238978.1, AA305205.1, AW673381.1, AA356819.1, AA330679.1,
AA375669.1, AA300800.1, AW140939.1, AA375100.1, AA331858.1, AA356680.1, AW673279.1, AI882004.1, W54494.1,
AI788163.1, AW210350.1, AI652229.1, AI216294.1, AA646398.1, AA592229.1, AW403775.1, AA162607.1,
AA162606.1, AW611267.1, AA144722.1, AW611275.1, AI787901.1, AU066662.1, AA274498.1, AI155006.1, C89118.1,
AA796937.1, AI041880.1, AW392797.1, AA779219.1, N87565.1, AA376043.1, AA036458.1, AA357218.1, D77137.1,
AA289702.1, AA869807.1, H34906.1, AA686674.1, AA003927.1, AA707035.1, AA331462.1, AW753648.1, D81695.1,
AW784181.1, AI082436.1, AA069953.1, N84531.1, AA144256.1, AW259083.1, AA376428.1, AI240672.1, AW259750.1,
AA209312.1, AA204777.1, AW494677.1, AW646970.1, AI240700.1, D77545.1, D21683.1, AV044678.2, AA370641.1,
AA795229.1, AW328791.1, AA495708.1, AV146088.1, AW872229.1, AW872191.1, AC018921.6, AC015519.1,
AC016153.4, AC013068.1, AC023802.7, AP000878.1, AC015972.3, AC008702.2, AC012297.3, AP000791.1,
AC068562.1, AC044804.1, AC026955.2, AC019024.3, AC023114.3, AC016282.3, AC016750.4, AC018804.2,
AC024228.1, AC021930.1, AC011129.3, AC016702.1, AL117349.9, AL020986.14, Z92862.1
SEQ ID NO: 444
ZH1239/T7

NM_007265.1, D88208.1, AE001159.1, AC006805.1, AC004009.1, AF072698.1, AL034560.3, AL049543.14,
AB010374.1, AB010351.1, AC008417.3, AE003790.1, AE003701.1, AE003583.1, AC009503.3, AF229187.1,
AC000134.14, AC022288.3, AF133290.1, AC016831.1, AF181897.1, AF053720.1, AC004673.1, U93237.1, AF017104.1,
U78486.1, AC004340.1, AL021127.2, AL136329.1, X98999.1, AL161582.2, AL161531.2, Z22181.1, AL096882.2,
AL049876.1, Z81533.1, Z84480.1, AL112418.1, Z98547.1, AL118618.1, AW612468.1, AW301001.1, AI174590.1,
AI655550.1, AI636702.1, AA582125.1, AA088312.1, AI469061.1, AI129538.1, AW205982.1, AI797450.1, N78688.1,
AW023577.1, W58626.1, AA457335.1, AW372225.1, AA701351.1, AW372193.1, N77826.1, T80582.1, AA894689.1,
AI796367.1, AA628695.1, N48358.1, H58914.1, AI640878.1, AI289462.1, AW578536.1, AA932627.1, I173007.1,
N99779.1, AI498752.1, H60477.1, AW361402.1, W58522.1, AW298385.1, R23840.1, AI932464.1, N75855.1, R06296.1,
AI587257.1, AA385517.1, AW130718.1, N49135.1, AA457241.1, AA026122.1, AI599581.1, AI599061.1, W15195.1,
AI932906.1, R06355.1, AW604635.1, AW434542.1, AI890809.1, AI103741.1, AI103538.1, AI044220.1, AW764290.1,
AW701196.1, AW555241.1, AW372223.1, AW261516.1, AW120503.1, AU021426.1, AU019817.1, AA832867.1,
AA470301.1, AU021511.1, AW555246.1, W14079.1, AW558345.1, C87021.1, C86542.1, AA691666.1, AI425788.1,
W80276.1, AW492846.1, AA899803.1, AW358584.1, AA160802.1, AA958403.1, AA981089.1, AA026589.1,
AA305411.1, AI931978.1, AA259679.1, AW058691.1, AI882965.1, AI545385.1, AI020739.1, AW749441.1, AV260861.1,
AW045116.1, AI883113.1, AV151030.1, AA818759.1, AA717672.1, AC068557.1, AC016394.3, AC009938.2,
AC015617.3, AC015593.2, AC068914.1, AC021559.3, AC021784.2, AC010947.3, AC026255.1, AC010899.3,
AC010826.2, AL121946.14, AL121932.15, AL157774.5, AL136380.2, AL355991.1, AP000813.1, AP0005621,
AC068537.2, AC064822.3, AC016776.2, AC026031.3, AC027338.2, AC027327.2, AC010586.4, AC012607.4,
AC016585.2, AC008767.4, AC009563.3, AC037454.2, AC019030.4, AC019212.3, AC011121.4, AC027248.2,
AC027086.2, AC025272.4, AC016780.5, AC021264.3, AC025292.6, AC010781.3, AC019351.3, AC021356.5,
AC011046.3, AC020674.4, AC023021.2, AC021557.3, AC021395.2, AC007646.7, AC018503.4, AC011912.3,
AC015490.3, AC007669.5, AC007650.6, AC019877.1, AC020443.1, AC017830.1, AC007976.3, AC007549.4,
AL109742.3, AL355528.3, AL159984.3, AL162274.4, AL049915.1, AP001187.1
SEQ ID NO: 445
ZH1246/T3

AJ012494.1, AB016873.1, AC007359.2, AC016752.2, AC013428.4, AC011560.4, AC008175.2, AF123280.1,
AL035670.29, AL031746.9, Z54218.1, AL049653.7, AB024028.1, AC005659.3, AF140042.1, AF149413.1, AF069772.1,
U48386.1, U32770.1, AL161667.1, AJ276875.1, Z92788.1, S93804.1, Z28117.1, AP000953.2, M73805.1, AC005957.2,
AC004988.2, U73479.1, AL163852.1, AL162751.1, AL050343.17, AI316374.1, AA122754.1, AI596711.1, AA168500.1,
AA684283.1, AI339046.1, AL275145.1, AA334894.1, R50891.1, R53342.1, R15006.1, AW413196.1, AA543789.1,
AA017943.1, AW456131.1, AA604894.1, Z84094.1, AW489233.1, AA827713.1, AA807856.1, AA971922.1, AA551525.1,
AW215047.1, AI715142.1, AW395964.1, AW654477.1, AA280722.1, N98571.1, H85699.1, R81264.1, T32856.1,
AW703298.1, AI993962.1, AI938007.1, AL227746.1, AV420160.1, AW739118.1, AW728338.1, AV442499.1,
AW585568.1, AW584470.1, AV330786.1, AW159353.1, AI736567.1, AI563324.1, AI440892.1, AA672822.1,
R80012.1, T38739.1, T38590.1, AW772878.1, AW766054.1, AW765344.1, AW765211.1, AW720989.1, AW676320.1,
AW676023.1, AW638856.1, AW429129.1, AW228541.1, AV393578.1, AV393030.1, AV392207.1, AV391210.1,
AV389867.1, AV389618.1, AV387850.1, AV387379.1, AV386705.1, AW216033.1, AW066715.1, AW032959.1,
AW017507.1, AI896863.1, AU060616.1, AI665500.1, AI111896.1, AA542534.1, C09510.1, D34272.1, AC018463.4,
AL161611.3, AC037474.2, AC026068.2, AC069100.1, AC025246.5, AC023342.2, AC008061.1, AC007965.2,
AC007315.2, AC011353.3, AC025722.1, AL353780.2, AL160280.2, AL139346.1, AC063945.3, AC068545.2,
AC068642.2, AC032011.3, AC026607.2, AC025515.2, AC016215.4, AL136233.3, AL355886.1, Z92853.1, AC027652.6,
AC011195.4, AC007990.2, AC020704.3, AC025479.2, AC013288.1, AL354875.3, AL354682.1, AL031745.7
SEQ ID NO: 446
ZH1246/17

AP131838.1, AL109628.2, AC008430.3, AC003991.1, U91322.1, AF007544.1, AL133371.2, Z98049.1, D00403.1,
NM_003368.1, AC007678.3, AE003774.1, AC003087.1, AC006376.2, AC005510.3, AF117386.1, AC004655.1,

TABLE 1-continued

Sequence homologies (GenBank Accession Numbers)

AF036876.1, AL049553.20, AL117575.1, AL117503.1, U82694.1, AL035411.27, AL109946.12, Z70274.1, AL109750.5,
AL021997.1, AL035671.5, 557147.1, U39854.1, Y13535.1, AB014458.1, AA046864.1, AA460137.1, W56251.1,
AW770864.1, AW274585.1, AW274012.1, AA121005.1, AW340730.1, AA838074.1, AA025284.1, AA463813.1,
AA025509.1, W72220.1, AA758578.1, AA865270.1, AI093268.1, AI809015.1, AA576920.1, AA04.6616.1, W79406.1,
W77964.1, AA765645.1, AI469964.1, AI090504.1, N28710.1, AL215777.1, AW069815.1, AI091875.1, AA575900.1,
W37590.1, AI051436.1, AA195169.1, AL262012.1, AI086990.1, AI086986.1, AI090622.1, AI688371.1, AA553947.1,
AI066619.1, AA744747.1, AI025326.1, AW085263.1, W79519.1, AI687571.1, AI359261.1, AI301033.1, AI129737.1,
AA666117.1, AA778035.1, AW662808.1, AA935141.1, W03467.1, AA150876.1, AL263263.1, AI480217.1, AI671927.1,
AL120648.1, AI811977.1, AA731247.1, W44726.1, T33329.1, R53947.1, AA252057.1, N67493.1, AI305238.1,
AI358639.1, AA115937.1, AA025323.1, C02044.1, AW779054.1, I73883.1, W60503.1, AA810051.1, AA652737.1,
AI089304.1, W38658.1, AI751448.1, T87823.1, H38074.1, AA460249.1, AI798193.1, T47322.1, AI963475.1, AI186363.1,
AA580432.1, AI911053.1, AA082082.1, AI610212.1, AA150749.1, I71930.1, AL216841.1, N49501.1, AA863123.1,
AA971960.1, AA730902.1, AA749453.1, AA461469.1, AA528506.1, AA994639.1, Z38836.1, AC026068.2, AL161420.5,
AL353574.2, AL161611.3, AC018569.3, AL162255.5, AL133479.9, AC018801.3, AC013780.3, AC024170.1,
AC022808.1, AL161450.4, AL354809.1, AF217246.2, AC026365.3, AC010323.4, AC008110.2, AC034234.1,
AC039323.3, AC024234.4, AL355151.3, AL136322.2, AL355922.1, AL354874.1, AL162372.3, AP001009.1, AP001525.1,
AC055882.3, AC027320.2, AC010255.4, AC010309.4, AC010441.4, AC011406.2, AC011408.4, AC008643.3,
AC008475.4, AC008450.3, AC034120.2, AC025008.2, AC026977.2, AC027052.2, AC040938.1, A0018945.3,
AC025396.2, AC025119.2, AC021971.3, AC023085.2, AC011178.3, AC016008.3, AC015917.4, AC020171.1,
AL157376.2, AL356432.1, AL356133.2, AL136224.4, AL355389.1, AL354894.1, AP001836.1
SEQ ID NO: 447
ZH1252/T3

NM_014570.1, AL159143.1, AF111847.1, AL137598.1, AL049758.11, AK002083.1, AF189776.1, AF189775.1,
AF189774.1, AFt 89773.1, AL022328.21, Z95703.1, AC007920.18, AE003635.1, AE003419.1, NM_005593.1,
AC007743.3, AP158386.1, AP158385.1, AL158061.1, ALL21806.2, X87247.1, X14894.1, L00676.1, M95285.1,
AI064747.1, AW407642.1, AA448950.1, AA133150.1, AA128508.1, AA223442.1, AA917502.1, AW407332.1,
AA988011.1, W14832.1, AA792131.1, AI390883.1, AA984552.1, AW389654.1, P14772.1, AW785941.1, AW159059.1,
AW795979.1, AI417756.1, AW675393.1, AW410339.1, AW403045.1, AW163692.1, AW163450.1, AW160901.1,
AA873254.1, AA350230.1, AA346899.1, AA323938.1, AA295297.1, W53209.1, AJ398955.1, AJ396546.1, AJ394216.1,
AA511562.1, H29613.1, R27796.1, T85026.1, AA249594.1, W96489.1, Z82199.1, AC024558.7, AC068818.1,
AC024045.3, AL139226.14, AL121881.30, AC021873.7, AC005128.7, AC069069.2, AC068763.2, AC068299.4,
AC025568.3, AC018752.3, AC010396.3, AC018694.3, AC022912.3, AC046154.1, AC015671.3, AC026759.1,
AC012308.4, AC015889.3, AC023283.3, AC021257.2, AC013306.4, AC012479.2, AC014140.1, AC020218.1,
AL162422.2
SEQ ID NO: 448
ZH1252/T7

NM_014570.1, AL159143.1, AF111847.1, AL137598.1, AL049758.11, AK002083.1, AF189776.1, AP189775.1,
AF189774.1, AF189773.1, AL022328.21, Z95703.1, AC007920. 38, AE003635.1, AE003419.1, NM_005593.1,
AC007743.3, AF158386.1, AF158385.1, AL158061.1, AL121806.2, X87247.1, X14894.1, L00676.1, M95285.1,
AI064747.1, AW407642.1, AA448950.1, AA133150.1, AA128508.1, AA223442.1, AA917502.1, AW407332.1,
AA988011.1, W14832.1, AA792131.1, AI390883.1, AA984552.1, AW389654.1, F14772.1, AW785941.1, AW159059.1,
AW795979.1, AI417756.1, AW675393.1, AW410339.1, AW403045.1, AW163692.1, AW163450.1, AW160901.1,
AA871254.1, AA350230.1, AA346899.1, AA323938.1, AA295297.1, W53209.1, AJ398955.1, AJ396546.1, A3394216.1,
AA511562.1, H29613.1, R27796.1, T85026.1, AA249594.1, W96489.1, Z82199.1, AC024558.7, AC068818.1,
AC024045.3, AL139226.14, AL121881.30, AC021873.7, AC008 328.7, AC069069.2, AC068763.2, AC068299.4,
AC025568.3, AC018752.3, AC010396.3, AC018694.3, AC022912.3, AC046154.1, AC015671.3, AC026759.1,
AC012308.4, AC015889.3, AC023283.3, AC021257.2, AC011306.4, AC012479.2, AC014140.1, AC020218.1,
AL162422.2
SEQ ID NO: 449
ZH1256/T3

AF069601.2, U48959.2, AF069603.1, AF069602.1, NM_005965.1, X85337.1, AF042089.1, M76233.1, 557131.1,
M76369.1, AF045269.1, M31048.1, X52876.1, U61731.1, U08979.1, AC009238.3, AE003700.1 NM_003458.1,
AF052224.1, Y18450.1, AC011455.6, AF238310.1, AE003771.1, AE003433.1, AE003420.1, AE003419.1, NM_010756.1,
AC004869.1, AC005903.3, AP184885.1, AC005684.1, AC005320.1, AC005368.1, U64857.1, Z54216.1, AL133315.1,
AL132651.1, AL022017.1, AB009693.1, X54143.1, X06589.1, AI425007.1, AL220448.1, AW728163.1, AA241767.1,
AW729690.1, AW727596.1, AW668218.1, AW668079.1, AW214693.1, AW142383.1, AI731262.1, AI642234.1,
AA567869.1, AI179188.1, AA674348.1, T87472.1, AC020634.4, AC023165.9, AC020634.3, AC026385.6, AC024888.5,
AC0I6575.6, AC008391.3, AC016618.4, AC024386.3, AC021572.2, AC007723.4, AC012997.1, AC008360.2,
AL353577.3, AC009321.5, AC026376.7, AC025809.2, AC007909.3, AC023403.2, AC021716.2, AC012508.3,
AC016329.2, AC013858.1, AC014319.1, AC019499.1, AC012815.1, AC007892.3, AC007439.5, AC006915.1,
AL080314.29, AL160289.3, AL133487.1, AP000923.2, AP000849.1
SEQ ID NO: 450
ZH1256/T7

NM_005965.1, X85337.1, AF069601.2, U48959.2, AF069604.1, X90870.1, AF069603.1, AF069602.1, AF096774.1,
AF096775.1, AF096773.1, 557131.1, 580867.1, M76233.1, AF096771.1, M76181.1, AY096770.1, AF096769.1, Y09530.1,
M76234.1, M14953.1, M96655.1, M31048.1, M88283.1, X52876.1, AF096768.1, M88284.1, AF045285.1, M96987.1,
AF096767.1, X52877.1, AL135784.4, AF045284.1, M88280.1, AE003492.1, S76114.1, AC003998.1, AC005005.1,
AF128893.1, AF121948.1, AF045281.1, AB016879.1, AC005743.5, AL050322.10, Z97181.1, AC000533.1, AC007089.3,
AC005386.1, AC006949.8, AC004806.1, AF045283.1, AC005152.1, AC004791.1, AC006368.2, AC007297.22, U51243.1,
AL163273.2, AL158059.2, AL138644.1, U61731.1, Z68330.1, AL034379.8, AL035466.3, AL021329.1, Z84465.5,
AP001728.1, D86998.1, AP000010.2, AE003817.1, AC022472.2, AC011604.10, AF081666.1, AFO81665.1, AF081664.1,
AF081663.1, AF081662.1, AF081660.1, AF081659.1, AF081657.1, AF081654.1, AF081650.1, AF081647.1, AC002101.1,
AL133214.12, Z83820.1, I01209.1, AJ230973.1, M60486.1, AC002378.1, AC006137.1, AP001412.1, AW439636.1,

TABLE 1-continued

Sequence homologies (GenBank Accession Numbers)

AW152647.1, AA846544.1, AI095622.1, AA613660.1, AI042420.1, AI925396.1, AA454065.1, AA541652.1, AI186177.1,
AW445149.1, W72714.1, W95026.1, AI125298.1, AA613440.1, AI187345.1, AW169345.1, AI126911.1, AA595987.1,
AA494344.1, AI146909.1, AA460946.1, AA461252.1, AI679797.1, AA991772.1, AI143142.1, AA594463.1, N99150.1,
AA935323.1, AI141982.1, AA635415.1, AI074102.1, M041798.1, AI167714.1, AA564147.1, AW470710.1, AA916523.1,
AI927798.1, AL268600.1, AA86.1048.1, AI302508.1, AL268755.1, AA142908.1, M288810.1, AL263251.1, AL204679.1,
AW130308.1, AA523611.1, AI658584.1, AI768972.1, AA652730.1, AA564626.1, AA535709.1, W93341.1, AA127948.1,
AW272989.1, AA722670.1, AA070691.1, AI078712.1, AI362419.1, AI810438.1, AA487215.1, AI769684.1, AW146368.1,
AA583542.1, H94293.1, AA573423.1, AA230313.1, AI167999.1, AI747300.1, AI746549.1, AA065228.1, AA127982.1,
T40866.1, T40854.1, AA65474.6,1, T55741.1, AI123173.1, N78697.1, W21325.1, AA150910.1, AI880477.1, AA534955.1,
W25537.1, AW461776.1, AA297864.1, AA524623.1, T40860.1, AA706108.1, AI462176.1, T94376.1, AA374739.1,
AW465934.1, AA487075.1, AA922346.1, AA853392.1, T40844.1, AA486775.1, T40852.1, AA099952.1, AC023165.9,
AC021861.3, AC009434.5, AC019234.3, AC063967.1, AC013275.4, AC018865.1, AL160169.2, AC016942.5,
AC011606.6, AC026386.4, AC025087.3, AF252829.1, AC019218.3, AC023812.3, AC022220.4, AC0219991,
AC010993.10, AW010994.9, AC011606.5, AC013198.1, AL132765.1, AC037043.2, AC058821.2, AC068489.1,
AC027297.5, AC021248.3, AC016365.4, AC023404.2, AL162733.2, AC021871.8, AC044806.1, AC025966.2,
AC025866.2, AC024647.2, AC016100.4, AC020616.3, AC002489.1, AL121930.10, AC064835.3, AC012055.6,
AC036171.2, AC008985.5, AC008878.6, AC008758.3, AC025196.2, AC027731.2, AC060828.3, AC020558.3,
AC018714.3, AC006375.3, AC009470.3, AC011117.4, AC025549.3, AC011034.3, AC022461.3, AC022673.3,
AC018535.3, AC010583.3, AC023003.2, AC013261.2, AL355880.2, AJ239319.3, AL158207.3, AP001815.1, AC011473.3,
AC006927.22, AC024728.2, AC012186.3, AC019091.2, AC012502.2, AL139115.4, AF254136.1, AL353142.3,
AL162211.3, AC055874.2, AC034280.2, AC068203.1, AC022231.8, AC026958.2, AC018629.3, AC027668.1,
AC011432.2
SEQ ID NO: 451
ZH1268/T3

NM_014673.1, D14659.1, AF146342.1, AC004741.1, NC_001224.1, AF152364.1, AL159140.2, AL161572.2, AJ011856.1,
Z70680.1, AL031703.1,1, AC2007878.2, AE003844.1, AE003787.1, AE003676.1, AE003519.1, AE003422.1, AE003217.1,
AE002613.1, NM_008062.1, AC004926.2, AC005521.1, AC005004.3, AC011713.2, AC006065.3, AF044676.1,
AL132641.2, AL162754.2, AL137228.2, U88534.1, AL021395.15, AL021406.1, U47058.1, AL078624.24, U59516.1,
U59515.1, L40698.1, U53501.1, I341028.1, X07467.1, Z11911.1, Z84471.1, M99599.1, AB020872.1, M26655.1,
AB013109.1, AL048716.3, AL038161.1, AA447858.1, AW204529.1, AI557375.1, AA821444.1, AW583644.1,
AW583578.1, AA385797.1, AA560410.1, AA870575.1, AA301506.1, AA471359.1, C83495.1, C82639.1, AA003181.1,
AI525324.1, AA855729.1, AA163000.1, AA187086.1, AW644280.1, AW765060.1, AI156263.1, AW646028.1,
AA137986.1, AA638895.1, AL204083.1, AA545015.1, AA687160.1, AW303995.1, AW009849.1, AI669342.1,
AI636359.1, AI555299.1, AA248265.1, AI566150.1, AI027953.1, AA530808.1, AI669343.1, AW639641.1, AW276600.1,
AI422353.1, AI616839.1, AW209495.1, AI679455.1, AI339009.1, AA873375.1, AA447703.1, AW764367.1,
AW592606.1, AI104356.1, AW548701.1, AV180860.1, AV178105.1, AV177100.1, C54380.1, C36065.1, D34365.1,
D33956.1, D33401.1, D27654.1, AW578603.1, AW229969.1, AW219265.1, AI921265.1, AI789557.1, AA894979.1,
AA839723.1, C79227.1, AA451834.1, AA451833.1, AC022634.3, AC012206.3, AP002079.1, AP002078.1, AC018351.8,
AC022295.7, AC062037.2, AC017100.3, AC010149.4, AC023940.2, AC022960.2, AC011257.3, AC025764.3,
AC027423.2, AC023592.2, AC013323.5, AC025712.2, AC025396.2, AC024945.2, AC015564.3, AC016105.3,
AC022040.2, AC007603.1, AC015594.1, AL121996.5, AL109923.21, AL355352.3, AL132867.12, AL162471.1,
AL139190.3, AL139418.1, AL049803.1, AP001990.1, AP001974.1, AC062004.2, AC068774.2, AC048384.2,
AC022414.3, AC025431.3, AC062001.1, AC023131.4, AC024031.2, AC025003.2, AC009353.7, AC022997.3,
AC018793.4, AC022529.3, AC021134.4, AC016035.3, AC019277.4, A0021225.3, AC011855.2, AC012390.5,
AC015675.1, AC012142.1, AC007905.1, AC005141.1, AL356355.2, AL353092.3, AL160275.2
SEQ ID NO: 452
ZH1268/T7

NM_014673.1, D14659.1, AC004492.1, AC009233.3, Z99133.1, AF178030.1, AC004838.2, AF048726.1, AL031430.1,
AL135878.2, AJ243213.1, AL138651.1, AL033392.5, Z81364.1, AC006231.18, AF225898.1, AC005875.2, AC007421.12,
AF028834.1, AL160191.2, Z99135.1, AJ232463.1, AJ232461.1, AJ232460.1, M232459.1, AJ232458.1, AL232456.1,
AL232466.1, AJ232465.1, AJ232464.1, AJ232454.1, AL232501.1, AL232462.1, U 1948.1, X68253.1, AC019209.3,
AE003578.1, AE003442.1, AE003426.1, AC006229.17, AC007151.2, AF030694.2, AC006150.2, AL232455.1,
AP000477.2, AC009478.4, AC006332.3, AE003518.1, AC007151.2, AF030694.2, AC006150.2, AC005185.1,
AF067217.1, AC004609.1, AC004075.1, AC003046.1, Z98551.1, AL133445.2, AL136296.2, Z95116.1, AL022159.1,
U07978.1, AI027953.1, AI636359.1, AI566150.1, AW276600.1, AI669342.1, AI669343.1, AI339009.1, AA447703.1,
AA887811.1, AI147898.1, AI679455.1, AA836064.1, AA873375.1, AA534251.1, AI422353.1, AA745251.1, AA708596.1,
AW130877.1, AW168287.1, AW303995.1, AI677854.1, AI420890.1, AA935810.1, AA938493.1, AA687160.1,
AA311297.1, T27967.1, AA301507.1, AA935814.1, N50202.1, AA683177.1, AA447858.1, N68048.1, AW009849.1,
AW198055.1, AA181333.1, AI555299.1, AW592606.1, AI104356.1, AA530808.1, AA545015.1, AA137986.1,
AW209495.1, AA893851.1, AI014068.1, AA067766.1, AL234816.1, AA638895.1, AA855729.1, AW123869.1,
AI557375.1, AL204083.1, AW539200.1, AI102630.1, AV171265.1, AI556341.1, L26817.1, AA797564.1, AI843449.1,
AV250940.1, AV359988.1, AV260102.1, AV257129.1, AV256340.1, AV253184.1, AV251229.1, AV249657.1,
AW124329.1, AV156582.1, AV172897.1, AV152635.1, AV1510011, AV127867.1, AV122251.1, AV113481.1,
AV088039.1, AV087948.1, AV087721.1, AV060620.1, AV058322.1, AV056999.1, AV048088.2, AV015847.1,
AA469099.1, DI 9285.1, Z36450.1, AV033019.1, AW204529.1, AV085824.1, AV127868.1, AV040300.2, AI150377.1,
AW764367.1, AW646028.1, AV129270.1, AV120629.1, AV060547.1, AI317280.1, AA286921.1, AC022634.3,
AC019351.3, AC025826.1, AL138828.4, AC055746.2, AC058784.2, AL355972.2, AL354717.1, AC068992.3,
AC053499.2, AC027191.2, AC011192.2, AC018608.4, AC023075.2, AL158149.3, AL138974.2, AL139234.1,
AL138683.2, AC008049.22, AC069066.1, AC036179.2, AC027652.6, AC025758.2, AC008705.4, AC011369.3,
AC026388.6, AC027212.2, AC026523.2, AC024736.3, AC019106.2, AC022216.3, AC011572.4, AC024451.2,
AC021937.2, AC021998.3, AC023632.1, AL356219.1, AL160003.4, AL138920.2, AP000878.1, AC010176.7,
AC026119.5, AC024902.5, AC034124.2, AC023666.3, AC027073.2, AC025380.2, AC004688.6, AC016998.1,
AC008182.1, AL355877.3, AL356259.1, AL139329.8, AL354836.1, AL353789.1

TABLE 1-continued

Sequence homologies (GenBank Accession Numbers)

SEQ ID NO: 453
ZH1275/T3

NM_005271.1, X07769.1, X07674.1, M20867.1, M37154.1, J03248.1, AC006144.1 NM_012084.1, X66310.1, U08997.1,
NM_008133.1, X57024.1, NM_012570.1, X14223.1, X14044.1, X66305.1, X66300.1, X66304.1, S60496.1, X66301.1,
X53144.1, X53147.1, X66313.1, S60498.1, X66303.1, X66316.1, X53146.1, X66318.1, S60497.1, X66302.1, X53149.1,
X53145.1, X53148.1, X66317.1, X66319.1, X66315.1, M17697.1, X66306.1, AE003745.1, Z29062.1, Y11314.1,
U86783.1, AL009204.1, NM_015985.1, AE003679.1, AE003489.1, NM_000277.1, AP113708.1, AF074332.1,
AC006065.3, U49897.1, AC004736.1, AL161757.2, AL162755.2, AL109865.36, S76376.1, L47726.1, K03020.1,
AB026191.1, W27073.1, AA227279.1, AA312202.1, AI789217.1, AW475321.1, AA014196.1, AA644784.1, AA383708.1,
AA879600.1, AA008302.1, W41789.1, AA360821.1, W26604.1, W71024.1, AA017175.1, AA138870.1, AW320856.1,
AA718335.1, AW045922.1, T19300.1, AA305029.1, AI640872.1, AI664278.1, AA072930.1, AW047896.1, AW380021.1,
AA797796.1, AA185893.1, H31226.1, AI882241.1, AW818494.1, AW609909.1, AW818582.1, AW128806.1,
AW280635.1, AW227033.1, P23009.1, W70382.1, W18826.1, W14066.1, AA187228.1, AI785754.1, AAI86507.1,
AI385127.1, AA321600.1, AA511913.1, N57779.1, AU050259.1, AA887581.1, N91217.1, AI930482.1, AA409430.1,
AI839659.1, AI193770.1, AA025731.1, R72482.1, N68424.1, AI388049.1, AA990898.1, AA561182.1, AI031170.1,
AA950162.1, AI658351.1, M137421.1, AW280723.1, AA817402.1, AA698796.1, AA950738.1, AI882716.1, AI723596.1,
AI477548.1, H66387.1, AA264699.1, AW620147.1, AI525665.1, AA160856.1, H47916.1, M78112.1, AI545578.1,
M056867.1, AA913604.1, AA682455.1, AA334497.1, AA203389.1, W01609.1, T97795.1, AL136982.1, AL133327.2,
AC024946.4, AC022400.4, AC007929.7, AC0082023, AC013137.1, AC023319.1, AC009274.5, AC026512.2,
AC027088.2, AC024498.2, AC024161.1, AC026108.5, AC024091.4, AC022224.19, AC064820.3, AC067975.1,
AC018613.3, AC019034.3, AC016486.4, AC004157.6, AC021685.3, AC016030.2, AC018534.3, AC023079.2,
AC022845.2, AC018786.2, AC016670.3, AC012065.3, AC020525.1, AC009512.4, AC013214.1, AC013225.1,
AC007571.4, AC005504.3, AC006104.1, AC004064.1, AL356099.1, AL161939.2, AL139005.1, AL136133.1, AP000974.2
SEQ ID NO: 454
ZH1275/T7

NM_005271.1, X07769.1, X07674.1, M20867.1, M37154.1, X66312.1, J03248.1, AC006144.1, X66310.1, U08997.1,
X67491.1, X66314.1, AF086070.1, NM_0125701 NM_008133.1, X14223.1, X14044.1, X57024.1, AL021396.5,
AC0049441, AE003805.1, AC011198.2, AE001699.1, AC004335.1, X92729.1, AW008481.1, AW161914.1, AL121462.1,
AI796326.1, AI767015.1, AI719871.1, M688677.1, AI685203.1, AI683603.1, AI609634.1, AW152299.1, AW778779.1,
AI936502.1, AI924085.1, AI870436.1, AL220414.1, AI017359.1, AI860803.1, AI518481.1, AI373143.1, AI476186.1,
AI432139.1, AI434555.1, AI052741.1, AW779007.1, AI453009.1, AA705949.1, AA612700.1, AA576729.1, AI346963.1,
AA719691.1, AW440634.1, AW299819.1, AI953347.1, AI669386.1, AW316988.1, AA579763.1, AI479598.1,
AI041934.1, AI865818.1, AA931220.1, AA639014.1, AW469758.1, AW105271.1, AI039164.1, AI628503.1, AI547078.1,
AI580269.1, AW131820.1, AI955767.1, AI768285.1, N55432.1, AW662165.1, AI949911.1, AA968749.1, AI948510.1,
H23769.1, AA205716.1, AA622009.1, AI766220.1, AI628736.1, AA961548.1, W32185.1, N58794.1, AA603980.1,
AL200249.1, AI433759.1, AI799717.1, AA227280.1, AW206141.1, AA507097.1, AI871324.1, AL220678.1, D19635.1,
AA506817.1, AI023057.1, AI167726.1, AA984899.1, H22628.1, AL119832.1, AI590208.1, AA995612.1, T29318.1,
H52944.1, AL220953.1, N62651.1, AI104010.1, AA932126.1, AW614089.1, AA352492.1, AI942453.1, H57922.1,
AA541774.1, AI424426.1, R54424.1, W69491.1, AA934829.1, AW779733.1, AI932689.1, AI582068.1, AL136982.1,
AL161935.5, AP001776.1, AL163534.3, AC021193.3, AC023150.2, AC007117.1, AL137063.5, AL160158.2,
AC025731.7, AC040988.2, AC063968.1, AC010902.3, AC022833.2, AC025924.2, AC021450.3, AC011791.3,
AC016365.4, AC016802.5, AC021761.3, AC023482.2, AC016991.2, AC020959.1, AC020024.1, AC018408.1,
AL160162.4, AL136088.2, AL133269.8, AL355140.2, AL354743.1
SEQ ID NO: 455
ZH1278/T3

NM_003011.1, U51924.1, X75091.1, M93651.1, D45198.1, AC005666.1, Z95126.1, AC007649.12, AC008865.3,
S68987.1, S68589.1, AL121985.13, AB015613.1, AB022692.1, AB022691.1, AF027174.1, AJ243486.1, AF102850.1,
AF032922.1, AF039698.1, AF103726.1, U48696.1, U34048.1, AF045432.1, AF033097.1, AJ243655.2, S78798.1,
AJ249625.1, U66300.1, U39066.1, AI004935.1, U37573.1, AJ001103.1, Z97178.1, AJ010903.1, U35663.1,
U30169.1, Z49980.1, D61704.1, AC004106.1, AL118512.8, S64573.1, AC011809.2, AF030515.1, AF061786.1,
AL121575.24, AC002091.1, AL277276.1, AJ277275.1, AL109941.17, S64574.1, X99051.1, D13957.1, AW804718.1,
AW297865.1, AI907472.1, AI348548.1, AW291539.1, AW819112.1, AW384700.1, AI656103.1, T19570.1, AI348464.1,
AW580047.1, AA738062.1, AW463846.1, AW390103.1, AW373693.1, AL022685.1, AI316314.1, AA611351.1,
AA549598.1, AA414765.1, AA123463.1, AA796821.1, AA667063.1, AA118033.1, C79263.1, AA607821.1, AW373676.1,
AW681843.1, AJ398907.1, AA714153.1, AA206519.1, AW390843.1, AA069741.1, AW842631.1, AV097455.1,
AL267315.1, AA329702.1, AA313621.1, AA233558.1, D54409.1, AA409879.1, H34224.1, AW375988.1, AW536757.1,
AA099025.1, AU045232.1, AW537027.1, AW375987.1, AW239416.1, AI768142.1, AA377175.1, AA356749.1,
AA318099.1, AA314914.1, AA296390.1, AA206939.1, AA074744.1, AA069861.1, AI981321.1, AW390108.1,
AA461024.1, AA474415.1, AW682597.1, AW209981.1, AL118403.1, C89073.1, AA624202.1, AA474356.1, AA170936.1,
AA103478.1, D28721.1, D21513.1, AW629348.1, AI101820.1, AL024232.1, AI467387.1, AA341055.1, AA122619.1,
AA793865.1, AW773136.1, AA179445.1, AW390844.1, AA606606.1, AW374608.1, AW638871.1, AW634071.1,
AW158383.1, C89511.1, AA377176.1, IJ47704.1, AI396687.1, AI815353.1, AW547461.1, AI815356.1, AA549660.1,
AW682308.1, AW543995.1, AW537538.1, AI477163.1, AI477134.1, AC067721.3, AC024160.2, AC016607.5,
AC008879.3, AC008818.4, AC023066.2, AL138838.2, AC036148.2, AC027472.2, AC068438.1, AC008905.5,
AC018394.2, AL163195.2, AC017015.3, AC027082.2, AP000831.1, AP000713.1, AC025974.2, AC018915.3,
AP001148.1, AC024503.2, AL161451.4, AC011076.2, AC068294.2, AC015767.1, AC027457.2, AC044882.2,
AL159155.2, AC021505.1, AC025391.3, AC044900.2, AC058821.2, AC026506.2, AC021248.3, AL121938.4,
AL136359.4, AL355150.3, AL162371.5, AL136312.1
SEQ ID NO: 456
ZH1278/T7

NM_003011.1, M93651.1, D45198.1, AC005666.1, X75091.1, Z95126.1, AC008865.3, U51924.1, ALl21985.13,
AC007649.12, AC004106.1, Y16709.1, Y16700.1, Y16698.1, AL049776.3, AC016940.7, AC016939.8, S68987.1,
S68589.1, U66083.1, U69568.1, AC002385.1, AC004816.1, AC002126.1, AC000055.1, AC007277.2, AL163491.1,

TABLE 1-continued

Sequence homologies (GenBank Accession Numbers)

Z86062.1, AB022692.1, AW868532.1, AW780330.1, AW591220.1, AW513750.1, AW293933.1, AW245056.1,
AW244076.1, AW168969.1, AW090022.1, AW083629.1, AW044189.1, AW007774.1, AI968676.1, AI950006.1,
AI936602.1, AI924906.1, AL037448.1, AI753576.1, AI654239.1, AI550115.1, AI564211.1, M524784.1, AI355458.1,
AI325543.1, AI311829.1, AI309210.1, AL276264.1, AL272933.1, AL253373.1, AL208354.1, AI161319.1, AI160942.1,
AI143855.1, AI123422.1, AI056850.1, AI032559.1, AI024969.1, AA989168.1, AA989103.1, AA953828.1, AA781061.1,
AA721786.1, AA716380.1, AA716371.1, AA694154.1, AA669764.1, AA644321.1, AA641186.1, AA634951.1,
AA634910.1, AA634838.1, AA630300.1, AA583450.1, AA577550.1, AA479216.1, AA450173.1, AA450108.1,
AA371437.1, AA314939.1, AA309906.1, AA309718.1, AA223348.1, AA206857.1, AA179301.1, AA160127.1,
AA062923.1, W26593.1, N67146.1, N41803.1, N32850.1, D29035.1, AA369866.1, AA074909.1, AW732805.1,
AL037182.3, AA917780.1, AA669856.1, AA478675.1, AA848156.1, AA363086.1, AA206002.1, AA063530.1,
AW801878.1, AW078466.1, AW303316.1, AI092597.1, AA579413.1, AA668238.1, AA578980.1, AA564790.1,
AA630703.1, AA482218.1, AA516095.1, AW674250.1, AA748113.1, AA737104.1, AI419588.1, AA352137.1, T94763.1,
AA714153.1, AC011076.2, AC023066.2, AC015767.1, AC067721.3, AC024160.2,, AC008905.5, AC008401.3,
AC027457.2, AC027082.2, AC036148.2, AC027472.2, AC024503.2, AL163195.2, AC016607.5, AC008879.3,
AC008818.4, AL138838.2, AC010951.4, AC018372.4, AC018394.2, AC017015.3, AP000831.1, AC021355.3,
AP000713.1, AL161451.4, AL121594.2, AC016150.5, AC068294.2, AC021853.3, AC015936.3, AC025624.3,
AC068198.6, A0023430.9, AC008558.4, AC008746.5, AC025802.2, AC005507.6, AC016711.3, AC013534.1,
AC005504.3, AC004710.3, AL162271.2
SEQ ID NO: 457
ZH1283/T3

Z49250.1, AF040964.1, AL110292.4, NM_015821.1, AC016752.2, AC008175.2, AF176523.1, Z81109.1, AC009303.2,
AE003567.1, AE003419.1, AC004615.1, AC007202.2, U66059.1, AL163256.2, AC000098.1, AL161541.2, Z70204.1,
AL021920.1, Z97338.2, AL109630.1, X04934.1, AP001711.1, X61440.1, X58329.1, X74843.1, L33104.1, AP000212.1,
AP000030.1, AP000251.1, AP000134.1, X94621.1, AW554727.1, AV336063.1, AV252097.1, AI747169.1, AI064780.1,
C79851.1, AW841034.1, AW174525.1, AI866180.1, AL289862.1, W13501.1, R73747.1, AL158068.4, AC027512.2,
AC011156.3, AC015497.3, AL353695.1, AC021861.3, AC012404.4, AC009682.3, AC026702.3, AC007322.3,
AC055867.1, AC026077.3, AC022973.2, AC008061.1, AC007965.2, AC007315.2, AL354884.2, AL353668.2,
AC020609.4, AC026116.7, AC064796.2, AC069023.1, AC027235.2, AC027313.2, AC022446.3, AC011370.2,
AC008561.3, AC024230.3, AC027386.2, AC044784.4, AC016309.6, AC026865.3, AC026277.3, AC010973.3,
AC022311.4, AC026276.2, AC027059.2, AC026070.2, AC018966.3, AC016412.3, AC023659.2, AC025523.2,
AC024956.3, AC013652.3, AC023115.3, AC022672.3, AC016483.6, AC016018.7, AC022841.2, AC016401.3,
AC010734.3, AC021338.3, AC016674.3, AC014321.1, AC014906.1, AC016354.1, AC015894.2, AC009703.2,
AC008084.2, AL356369.1, AL135924.10, AL139238.2, AP001257.1
SEQ ID NO: 458
ZH1283/T7

AF040964.1, Z49250.1, Z83850.1, AE001145.1, AF191070.1, AC009248.6, AF016450.2, U61946.1, U49830.1,
NM_014386.1, AF182034.1, AC020647.9, AF118125.1, AL034371.16, AL033127.1, U19575.1, AC007232.5,
AC008269.3, AF130342.1, AL035464.20, AL080238.9, AL034427.1, AP000561.1, AI808442.1, AA664012.1, AI628516.1,
AA630380.1, AW043655.1, R69790.1, R69789.1, AW513701.1, H56500.1, H56688.1, Z21088.1, AA652148.1,
AW610692.1, AW553895.1, AI451124.1, C80481.1, AI462312.1, C85371.1, AI591821.1, H61855.1, M604189.1,
AA177891.1, AI449315.1, AW554802.1, U83055.1, AV314215.1, AV207115.1, AV295151.1, AV368467.1, AV214236.1,
AV295152.1, AV257539.1, AV295169.1, AV367514.1, D29398.1, AA183653.1, AW681938.1, AW046876.1,
AV145607.1, AA210324.1, AA174896.1, AW079106.1, AU012850.1, AU012683.1, AU012324.1, AU006614.1,
AA332492.1, AW414996.1, AW339249.1, AW335085.1, AW158276.1, AL037685.2, AI807819.1, AI641202.1,
AI544578.1, AI477034.1, AI443114.1, AI440704.1, AA940518.1, D72454.1, D27504.1, AL158068.4, AC019140.3,
AC040892.1, AC011566.3, AC016963.7, AC010302.3, AC021353.3, AC013807.3, AC027533.1, AC012056.3,
AC026215.1, AL133326.8, AP001257.1, AP001181.1, AP000726.2, AC036220.2, AC025435.3, AC010314.4,
AC034172.2, AC025660.2, AC009957.5, AL139134.4, AL353765.3, AL353739.2
SEQ ID NO: 459
ZH1285/T3

NM_016520.1, AF218421.1, AF151054.1, AL137549.1, NM_016482.1, AL122003.17, AE003472.1, AC005557.1,
U89363.1, AF1198711 NM_014008.1, AF235097.1, AC004843.1, AF130342.1, AF005370.1, AL031984.13, AJ005890.1,
AC009303.2, AC004136.2, AC010072.5, AC002386.1, NM_003834.1 NM_001761.1, AC007240.2, AF152489.1,
AC006257.1, AC005938.1, AF035154.1, AF035153.1, AC005214.1, AC002398.1, AL163290.2,
AL163264.2, U17105.1, AB016929.1, AL161559.2, AL161542.2, AL033510.1, AL133247.1, AL137579.1, AL035394.1,
Z97339.2, Y14523.1, X15485.1, Z31356.1, X04333.1, AP001745.1, AP001719.1, AP001620.1, Z36714.1, AP000166.1,
AP000051.1, AB015114.1, AP000317.1, AP000119.1, AP000355.1, M21356.1, M74420.1, AB007976.1, AC016109.3,
AC027008.2, AL158207.3, AC025982.2, AC010038.3, AC018306.1, AC021040.3, AC025346.1, AC068892.1,
AC010543.4, AC009128.5, AC027761.2, AC041028.1, AC021615.4, AC018614.3, AC009335.2, AC023278.2,
AC010910.6, AC018377.4, AC022983.2, AC023266.2, AL138752.3, AL354885.1, AL157717.2, AL161665.1,
AC055765.6, AC025569.5, AC024523.2, AC026799.2, AC026736.3, AC010249.5, AC008641.4, AC008432.3,
AC009274.5, AC027450.2, AC027256.2, AC009677.3, AC060871.1, AC052251.1, AC026621.2, AC044807.1,
AC026585.2, AC011924.4, AC019004.3, AC008707.3, AC021818.3, AC027718.1, AC022036.3, AC022298.8,
AC024535.2, AC022909.4, AC021404.3, AC021260.4, AC024020.2, AC008579.2, AC023300.3,
AC011725.2, AC022315.5, AC010687.2, AC024161.1, AC021350.2, AC009881.3, AC010953.1, AL354883.4,
AL356139.2, AL162579.4, AL355363.2, AL353772.1, AL162390.3, AL161740.4, AP001586.1, AW161972.1, W26201.1,
AA132627.1, AA317976.1, AU035568.1, AW431809.1, AW446432.1, AI767692.1, AA122999.1, AW404731.1, C84411.1,
AA001736.1, AW867890.1, AA672516.1, AA067123.1, AI117776.1, AI527151.1, AI120866.1, AI651600.1, M514054.1,
AA568390.1, AW342787.1, AA317456.1, W69638.1, AW058741.1, AI158344.1, AA897584.1, W10607.1, AW786051.1,
AI082881.1, D47367.1, AW859546.1, AW498709.1, AW233754.1, AV272856.1, AA944898.1, AA458784.1, T08446.1

TABLE 1-continued

Sequence homologies (GenBank Accession Numbers)

SEQ ID NO: 460
ZH1285/T7

AF040964.1, Z49250.1, Z83850.1, AE001145.1, AP191070.1, AC00924& 6, AF016450.2, U49830.1, NM_014386.1,
AF182034.1, AC024869.1, AC020647.9, AF118125.1, AC007232.5, AF130342.1, AL035464.20, AL080238.9,
AL034427.1, AP000561.1, AI808442.1, AA664012.1, AI628516.1, AA630380.1, AW043655.1, R69790.1, AW513701.1,
H56500.1, R69789.1, H56688.1, Z21088.1, AA652148.1, AW610692.1, AW553895.1, AI451124.1, C80481.1,
AI462312.1, C85371.1, AI591821.1, AI604189.1, AA177891.1, AI449315.1, AW554802.1, U83055.1, AV314215.1,
H61855.1, AV207115.1, AV295151.1, AV368467.1, AV214236.1, AV295152.1, AV257539.1, AV295169.1, AV367514.1,
D29398.1, AA183653.1, AW681938.1, AW046876.1, AV145607.1, AA210324.1, AA174896.1, AA332492.1,
AW414996.1, AW339249.1, AW335085.1, AW158276.1, AV385524.1, AL037685.2, AV183523.1, AV178057.1,
AI807819.1, AI696097.1, AI626600.1, AI544578.1, AI477034.1, AA980276.1, AA928231.1, C65891.1, C61074.1,
C53590.1, AA279783.1, C10643.1, AL158068.4, AC026977.2, AC019140.3, AC040892.1, AL133373.1, AC010302.3,
AC009795.3, AC013807.3, AC027533.1, AC012056.3, AC006906.2, AL133326.8, Z82209.1, AP001257.1, AP001181.1,
AP000726.2, AC036220.2, AC025435.3, AC010314.4, AC009436.2, AC034172.2, AC025660.2, AC012528.2,
AC009957.5, AL353739.2
SEQ ID NO: 461
ZH1286/T3

AL117590.1, AC007245.3, AC003683.1, AL355072.2, AE003652.1, AC005120.1, AC006214.1, AL161550.2,
AL021687.1, AC007063.5, AC004535.1, AC013453.1, AC004752.1, AL049777.5, AL096862.18, AF000265.1,
AL132764.1, Z70205.1, AP000139.1, AP000226.1, AP000087.1, D85389.1, AC005970.2, AC021640.5, AC006287.1,
AE001368.1, AC004629.1, AL163232.2, AL049860.8, AB031177.1, AL031733.3, AL031600.4, Z82195.1, AL031653.5,
AP001687.1, AA175375.1, AI740728.1, AA332493.1, AI074062.1, AI580915.1, AI087846.1, AI510796.1, AW874606.1,
AI016838.1, AA470819.1, W85623.1, W85600.1, AI449083.1, AI549242.1, AI845400.1, AV015395.1, AV375672.1,
AV327111.1, AV354227.1, AI383006.1, AV300969.1, AV253424.1, AI604667.1, AA771574.1, AV376539.1,
AW332467.1, AW642408.1, AW636829.1, AW635398.1, AW634742.1, AW634652.1, AI467036.1, AA285835.1,
AL135649.1, AV377755.1, AI915385.1, AV064014.1, AV062554.1, AA808321.1, AA525659.1, AA458724.1,
AA232022.1, AA118229.1, R12836.1, T37449.1, AC034212.3, AC022121.3, AC008522.4, AC008531.2, AC011129.3,
AC025069.3, AC021824.2, A0023528.3, AC020916.4, AC023808.3, AC004689.5, AL354852.3, AC036175.2,
AC019106.2, AC019274.3, AC015595.3, AC006280.6, AC022947.2, AC023567.2, AC022977.1, AL137780.2,
AL135926.4, AC048385.2, AC016650.4, AC032009.2, AC005077.2, AC027637.2, AC015497.3, AC021515.3,
AC025385.2, AC019328.4, AC021562.3, AL354805.2, AL139284.3, AL355811.2, AL031749.7
SEQ ID NO: 462
ZH1286/T7

AC007190.4, AC005698.1, AL163244.2, AP001699.1, AP001604.1, X89454.1, X95537.1, X99111.1, AF241733.1,
AE003837.1, NM_010743.1, AC004240.1, AC005483.1, AC005017.1, AC010675.4, AC012561.2, AC005430.1,
AF022978.1, AC005209.1, AF027390.1, AC002368.1, AL121841.5, AL133239.2, AL031856.1, Z81519.1, X65721.1,
X60184.1, D26185.1, L16865.1, AB015478.1, M24843.1, Z99124.1, N78373.1, AA046865.1, AI074753.1, W23958.1,
W58729.1, AI570623.1, AA662071.1, AL283307.1, N24666.1, AI042238.1, AI871705.1, AI308931.1, N29591.1,
N35457.1, AA121714.1, N35732.1, AA662105.1, AI077613.1, c02199.1, N94508.1, AW193423.1, AW137463.1,
AW087689.1, AI932544.1, AI023068.1, AI016553.1, AA668903.1, AA603950.1, AA569968.1, W81286.1, W45153.1,
AI077894.1, AW316941.1, AA046618.1, AI468297.1, AI468375.1, M952677.1, AA534051.1, AW339939.1, AI136305.1,
AA801116.1, AA801115.1, AW488840.1, AV326475.1, AV307940.1, W80228.1, AI407687.1, AW392276.1,
AV313326.1, AV338001.1, AV327247.1, AV220383.1, Z98519.1, AV327255.1, AV235696.1, W45104.1, AV353938.1,
AV221367.1, AA472496.1, AV174463.1, AV344161.1, AV340653.1, AV229817.1, AI615511.1, AV343186.1,
AV341443.1, AA561896.1, AA240049.1, AI099985.1, W43492.1, AV008073.1, AC034212.3, AC022121.3, AC008522.4,
AC008531.2, AC009423.2, AL157399.2, AC018905.3, AC025281.2, AC009024.5, AC010086.3, AC034141.2,
AC024681.2, AC024087.3, AC018732.5, AC022568.3, AC023249.1, AC022030.1, AC021343.1, AC009454.1,
AP001120.1, AC015547.5, AC063918.4, AC022275.9, AC010275.4, AC009579.3, AC027256.2, AC016073.2,
AC024714.4, AC009504.3, AC018970.4, AC008709.2, AC019358.3, AC016677.1, AC007685.2, AF125956.1,
AC022695.3, AC015956.3, AC020706.3, AC021955.2, AC022694.2, AC019068.3, AC020392.1, AC005415.6,
AC007139.1, AL157413.7, AL138710.3, AL255887.1, AL356032.1, AL133474.8, AL121890.19, AL021152.1,
AL157696.2, AP001655.1, AP001654.1, AP001381.1, AP000902.2
SEQ ID NO: 463
ZH1288/T3

X68060.1, M27504.1, X86455.1, X86456.1, NM_009409.1, D38046.1, AB007446.1, AF087149.1, ZI5115.1, AB007445.2,
AB009387.1, Z19552.1, Z46372.1, L04607.1, Y16594.1, Y16595.1, NM_0116231 D12513.1, NM_001067.1, J04088.1,
AF071740.1, AJ011745.1, AJ011746.1, AF013277.1, AF087148.1, Z49069.1, M13814.1, Z94277.1, Y14559.1,
AJ238786.1, Z71364.1, X89016.1, L21015.1, D82024.1, NC_001224.1, AC004622.1, AL135749.2, AJ011856.1,
V00700.1, L36900.1, K00384.1, J01462.1, K01981.1, M35613.1, NM_014920.1, AF106577.2, AC005413.1, AL136296.2,
Z81521.1, Z81117.1, Z30974.1, AB023153.1, X79345.1, AC008186.2, AF016677.1, AC007685.2, AF125956.1,
AC004210.1, U67558.1, AL035078.32, AL134583.1, AW502948.1, D56256.1, M649350.1, AL041840.1, M648781.1,
AW369469.1, AA517639.1, AL040877.1, AI959436.1, AI648275.1, AL042407.1, AA080801.1, AW719663.1, AI806632.1,
AA872214.1, AA847887.1, AA766751.1, AW683426.1, AW257697.1, AI635985.1, AI619958.1, AI455477.1,
AA321068.1, AA309468.1, AC012037.8, AC022906.1, AC018629.3, AC015851.3, AC069032.1, Z99713.1, AL162716.4,
AC025833.2, AC011754.3, AC010903.3, AC069243.1, AC060776.2, AC008497.4, AC010756.2, AC021580.3,
AC020692.1, AC016863.2, AL133461.2, AC025371.2, AC013372.5, AL353627.1, AL049183.5, AC026328.3,
AC046164.2, AC062039.1, AC007366.3, AC022526.4, AC025800.2, AC013364.7, AC012118.2, AC023349.2,
AC023287.3, AC006844.1, AL117381.13, AL136038.1
SEQ ID NO: 464
ZH1288/T7

AF087160.1, ZI5115.1, U54831.1, X68060.1, X86456.1, X86455.1, NM_009409.1, D38046.1, AJ011732.1, AJ011731.1,
AB007446.1, AF087159.1, AL133396.1, AJ011730.1, AF043705.1, AF025469.1, AE003821.1, AC004808.1, AC002074.1,

TABLE 1-continued

Sequence homologies (GenBank Accession Numbers)

AC006314.2, AC005852.1, AL163243.2, AL132847.1, Z73423.1, AL023835.1, X72263.1, AP001698.1, AP001603.1,
AP001602.1, AI591391.1, AL261517.1, AI338649.1, AW664997.1, AW515712.1, AW467306.1, AW467294.1,
AW418947.1, AW192951.1, AW183653.1, AW006531.1, AI989480.1, AI69601.1,1, AI694881.1, AI679913.1, AI679406.1,
AI523670.1, AI478835.1, AI373284.1, AI348003.1, AI339647.1, AI335268.1, AI318389.1, AI304812.1, AL278060.1,
AL272011.1, AI039289.1, AA953079.1, AA904801.1, AA779797.1, AA721732.1, AA424359.1, AA115017.1, W93707.1,
W46532.1, AW269912.1, AI917755.1, AI766280.1, AI656688.1, AI560886.1, AI476680.1, AI144514.1, AI089698.1,
AA992925.1 AA953420.1, AA620947.1, AA555180.1, AW291834.1, AW515720.1, AW078947.1, AI304903.1,
AW118156.1, AI631155.1, AI309222.1, AI050083.1, AA708813.1, AA055323.1, AA973445.1, AA922984.1, H97974.1,
AI694605.1, AA424448.1, AW274857.1, AI831468.1, AA031925.1, AW272870.1, AI694343.1, AL280170.1, AI039017.1,
AA826849.1, AA621113.1, AA199624.1, AI097265.1, AA031996.1, W46206.1, N63584.1, AI637932.1, W57560.1,
AW188889.1, AI758405.1, W93759.1, W32771.1, H89909.1, AI659327.1, W26487.1, AW244066.1, AA115016.1,
T29334.1, AA807183.1, W57766.1, AW049818.1, D59157.1, AW523616.1, AI935392.1, AI059170.1, AW141413.1,
AA259497.1, AA238444.1, AI177826.1, AA946055.1, AC012037.8, AC009729.4, AC025004.2, AC016714.2,
AC021540.2, AC009490.5, AL355392.2, AL109808.2, AC068479.1, AC018624.3, AC017068.3, AC021436.3,
AC006721.1, AC026405.2, AC010585.4, AC031978.2, AC027285.1, AC025054.2, AC012432.4, AC023873.2,
AC009425.2, AC007356.7, AC0L2229.2, AC017352.1, AC015609.2, AL355307.2, AL354732.4, AL138875.3,
AL355304.3, AL355527.1, Z93243.1
SEQ ID NO: 465
ZH1308/T3

AL117590.1, AC007245.3, AC003683.1, AL355072.2, AL021687.1, AC007063.5, AC021640.5, AC003082.1,
AC004535.1, AL049777.5, AL096862.18, AL132764.1, AP000139.1, AP000226.1, AP000087.1, D85389.1, AC011493.4,
AC005662.2, AC002354.2, AE003163.1, AC007536.9, AE100956.1, AC004629.1, AL163232.2, AL031177.1,
AL031733.3, AL031653.5, AP001687.1, M77182.1, M75889.1, AI740728.1, AA175375.1, AA332493.1, AW874606.1,
AI810796.1, AI087846.1, AI074062.1, AI016838.1, AA470819.1, AI580915.1, AI549242.1, AI383006.1, AI449083.1,
AI845400.1, W85623.1, W85600.1, AV375672.1, AV015395.1, AV327111.1, AI741614.1, AV300969.1, AV354227.1,
AV376539.1, AV283831.1, AV253424.1, AW122375.1, M604667.1, AA771574.1, AW642408.1, AW636829.1,
AW635398.1, AW634742.1, AW634652.1, AW332467.1, AI467036.1, AA285835.1, AL135649.1, AV377755.1,
AI915385.1, AV173187.1, AV064014.1, AV062554.1, AI347646.1, AA808321.1, AA525659.1, AA458724.1,
AA232022.1, AA118229.1, R12836.1, T37449.1, AC034212.3, AC022121.3, AC008522.4, AC008531.2, AC021824.2,
AC023528.3, AC040943.2, AC036206.2, AC020916.4, AC023808.3, AC011129.3, AC025449.3, AC019274.3,
AC015595.3, AC006280.6, AC022977.1, AC013702.2, AL137780.2, AC048385.2, AC032009.2, AC021515.3,
AC026097.1, AC021562.3, AL354805.2, AL355811.2, AL035477.5, AL034557.7, AL031749.7
SEQ ID NO: 466
ZH1308/T7

AC005884.1, AC006395.1, AC007190.4, AC005698.1, AC005345.1, AE000323.1, AL163244.2, AC002066.1,
AJ133269.1, D90866.1, D90865.1, AP001699.1, AP001604.1, X89454.1, X95537.1, X99111.1, AF241733.1, AE003837.1,
NM_010743.1, AC004240.1, AC005483.1, AC005017.1, AC004381.1, AC007106.6, AC005430.1, AF051676.1,
AC005209.1, AF027390.1, AC004399.1, AC002368.1, AL121841.5, AL133239.2, Z81519.1, X65721.1, X60184.1,
X68090.1, AB015478.1, M24843.1, AI074753.1, N78373.1, AA046865.1, W23958.1, AI077613.1, N94508.1, W58729.1,
AI570623.1, AA662071.1, AL283307.1, N24666.1, AA121714.1, AI023068.1, N35457.1, AI042238.1, N35732.1,
AA662105.1, AI871705.1, AI308931.1, N29591.1, C02199.1, AW193423.1, AW137463.1, AW087689.1, AA603930.1,
W45153.1, AI016553.1, AA668903.1, AA569968.1, W81286.1, AI932544.1, AI077894.1, AW316941.1, AA046618.1,
AI468297.1, AI468375.1, AA534051.1, AI952677.1, W45104.1, AI136305.1, AA801116.1, AA801115.1, AW488840.1,
AW392276.1, AV339939.1, AV326475.1, AV307940.1, W80228.1, AV313326.1, AI407687.1, AV338001.1, Z98519.1,
AV220383.1, AV327247.1, AV235696.1, AV327255.1, AV353938.1, AV221367.1, AA472496.1, AV344161.1,
AV174463.1, AV340653.1, AV229817.1, AI615511.1, AV343186.1, AV341443.1, AA561896.1, AA240049.1,
AA718024.1, AI099985.1, W43492.1, AI927150.1, AC034212.3, AC022121.3, AC008522.4, AC008531.2, AC008245.2,
AC009423.2, AC018905.3, AC025281.2, AC018640.1, AC010536.3, AC009024.5, AC010086.3, AC009690.3,
AC034141.2, AC008706.2, AC024681.2, AC024087.3, AC018732.5, AC022568.3, AC023249.1, AC022030.1,
AC021343.1, AC009454.1, AP001120.1, AC015547.5, AC055864.2, AC027411.2, AC010275.4, AC008763.4,
AC068171.1, AC009579.3, AC013307.4, AC016073.2, AC024714.4, AF235106.1, AC008709.2, AC025966.2,
AC013744.3, AC022913.3, AC022695.3, AC024133.2, AC017058.4, AC022694.2, AC012168.6, AC019068.3,
AC012448.3, AC020392.1, AC005415.6, AL356274.2, AL162231.4, AL355887.1, AL356032.1, AL133474.8,
AL121890.19, AL021152.1, AL157696.2
SEQ ID NO: 467
ZH1310/T3

NM_014684.1, AB002371.1, AF176816.1, U28738.1, AC004492.1, AL117667.2, AC020728.4, AC007738.2, AC007746.3,
AC004082.1, AL163269.2, AL163217.2, AF002196.1, AC000114.1, Z80223.1, AL023835.1, Z78013.1, Z95116.1,
AP001724.1, AP001672.1, AJ229041.1, AA731488.1, AW510899.1, AI425080.1, AA805758.1, AA740870.1,
AW379875.1, AI137203.1, AA514569.1, AV426088.1, AV425335.1, AV417571.1, AV417509.1, AV410321.1,
AV408706.1, AV407889.1, AV429307.1, AV203109.1, AV196140.1, AI702988.1, AU031977.1, C71395.1, C63479.1,
AA101793.1, T39979.1, D37593.1, D34838.1, AV421197.1, AW612721.1, AW601552.1, AW295899.1, AV316295.1,
AV217403.1, AW080057.1, AI912653.1, AV200025.1, AV184265.1, AV183798.1, AV182538.1, AV177977.1,
AV177844.1, AV123582.1, AV098669.1, AI739163.1, AI701705.1, AI688792.1, F19452.2, AI534462.1, AI395032.1,
AA999602.1, AA807666.1, AA658626.1, C64557.1, C53782.1, C53639.1, C52086.1, C51614.1, AA513926.1,
AA341985.1, AA284009.1, T61753.1, D32789.1, T01101.1, AC044815.2, AC026587.2, AL355598.3, AC016598.3,
AC026231.1, AF165146.1, AL137879.3, AC026791.2, AC008952.4, AC009333.8, AC009054.4, AC010726.3,
AC026932.2, AC027003.2, AC009633.4, AC020739.4, AC022812.2, AC012481.2, AL157774.5, Z95311.10, AP001498.1,
Z83124.1
SEQ ID NO: 468
ZH1310/T7

NM_014684.1, AB002371.1, AL049382.1, AF176816.1, AC005561.2, AC021198.2, U41543.1, AC004059.2, AF095703.1,
AL035705.22, AF000198.1, AC006807.1, AP187015.1, AC005483.1, AC009743.1, AC0062.53.4, AF092091.1,

TABLE 1-continued

Sequence homologies (GenBank Accession Numbers)

AF020503.1, U43574.1, AL132877.2, AK000060.1, AC024827.1, AC011809.2, AC016827.5, AC004861.1, AF122982.1,
AC006265.1, AL161562.2, AL035451.5, AP000017.2, X95541.1, AI307250.1, AL271439.1, AI650441.1, AI017475.1,
AI672237.1, AL251828.1, M350623.1, AW513806.1, AI374969.1, AA483351.1, AI334985.1, AI146704.1, AA629033.1,
AI000570.1, AW594414.1, AI491723.1, D45489.1, AL049146.1, AI143491.1, AW020704.1, AL208598.1, AW795365.1,
AA779644.1, AL256761.1, T18542.1, AW485825.1, AW429714.1, AV279572.1, AV276939.1, AI585504.1, AW656607.1,
AA138162.1, AJ397541.1, AI799424.1, AI793220.1, AI793043.1, AI702885.1, AL262125.1, AA972361.1, AW664166.1,
AW418951.1, AW298528.1, AW129197.1, AW070252.1, AI984802.1, AI669330.1, AA970231.1, AA912726.1,
AA329579.1, D34789.1, AW783019.1, AW765809.1, AW684085.1, AW067635.1, AU058169.1, AI563818.1, AI098926.1,
C66867.1, AA329912.1, AC024063.1, AC008413.5, AC010220.3, AC026739.3, AC008375.6, AC008733.4, AC009194.2,
AC01V110.3, AC025244.2, AC021524.4, AC006782.2, AC000016.1, AC016969.11, AC012514.8, AC022250.2,
AC008558.4, AC018623.4, AC024005.2, AF130866.1, AL158157.2, AL138705.3
SEQ ID NO: 469
ZH13310/T3

NM_016310.1, AF051316.1, AF126531.1, Z69719.1, AE003791.1, AF165923.1, M97636.1, AF132734.1, AC022355.3,
AF002223.1, NC_001142.1, AE003708.1, AE003632.1, AC002045.1, AC002039.1, U91326.1, AC002544.1, AF095725.1,
AC004263.1, U78308.1, U76377.1, U53580.1, M94081.1, AE000662.1, AL121866.13, AL161548.2, AL096711.9,
AL049828.3, Z29560.1, AL022326.1, AL021408.1, AL021713.1, Z49311.1, Z48229.1, AW167513.1, AW138186.1,
AI760367.1, AA263042.1, AL224102.1, AA314434.1, AI094028.1, AI074736.1, AL220149.1, AI313394.1, AI082184.1,
AL268800.1, AA476966.1, AA126951.1, AW672863.1, C00817.1, AW385705.1, AI369802.1, AA773182.1, AW275005.1,
AA352782.1, AA827399.1, AA669773.1, AL241541.1, AI569242.1, AI913788.1, AA912503.1, AW426495.1,
AW381929.1, AW429636.1, AW426017.1, AW785359.1, AW418739.1, AW793665.1, AA271604.1, W98752.1,
AA009299.1, W59077.1, AL286727.1, AA118991.1, AI122511.1, W64539.1, AA822533.1, AA199237.1, AA051263.1,
AA537627.1, AA590075.1, AA198139.1, AW488481.1, AA604039.1, AI868548.1, AA268809.1, H31197.1, AI368581.1,
AA837254.1, AW484117.1, AW484121.1, AI858883.1, AW675452.1, AA691124.1, AW003500.1, AW528612.1,
AA120383.1, AI415794.1, AW637653.1, AU014893.1, AA606218.1, AW452227.1, AA413355.1, AW739254.1,
AA736083.1, AA696686.1, AW689226.1, AW346361.1, AW302482.1, AW273452.1, AW172797.1, AI953902.1,
AI814500.1, AI742562.1, AI674413.1, AI537928.1, AA948029.1, AA752389.1, AA582962.1, AA558493.1, AA555398.1,
AA550767.1, AA542978.1, AA534864.1, AA533877.1, AA532234.1, AA532318.1, H07126.1, T67650.1, AC010552.3,
AC007604.1, AP001005.1, AC020707.2, AC018350.2, AC015996.2, AC009218.6, AC016019.3, AC020202.1,
AC007837.3, AL136096.6, AL138723.4, AP001008.2, AC023794.9, AC023320.2, AL136967.2, AC026709.2,
AC010638.4, AC064794.1, AC025228.2, AC023388.2, AC012645.4, AC009152.5, AC008956.5, AC011967.3,
AC016002.5, AC044828.1, AC016516.3, AC023068.3, AC011999.3, AC014357.1, AC005136.1, AL162731.2
SEQ ID NO: 470
ZH13301/T7

AF126531.1, Z69719.1, NM_016310.1, AF051316.1, AC067968.1, AC005034.1, AE002102.1, AL109943.18, Z98946.15,
Z68887.1, Z50112.1, D88193.1, M97636.1, AE002705.1, AC008015.5, AC024874.1, AC004011.1, AC018363.6,
AC005018.2, U80837.1, AF061282.1, AL021492.1, Z82270.1, AB018007.1, AF132287.1, AE003632.1, AC003075.1,
AC005158.2, AL163279.2, AL163278.2, AL034556.3, AL161537.2, U39367.1, U30841.1, D31785.1, AL021531.1,
AW167513.1, AW138186.1, AI760367.1, AL224102.1, AI094028.1, AI074736.1, AI369802.1, AL220149.1, AI313394.1,
AI082184.1, AI569242.1, AL241541.1, AA126951.1, AA912503.1, AI913788.1, AW275005.1, AA773182.1, AW418739.1,
AA263042.1, AA827399.1, AA669773.1, AL268800.1, AI868548.1, AA314434.1, AI368581.1, AA837254.1, AC015972.3,
C00517.1, AA476966.1, AA604039.1, AW675452.1, AW672863.1, AW426495.1, AW426017.1, AW381929.1,
AA352782.1, AI858883.1, AW785359.1, AW429636.1, AW488481.1, AA537627.1, AA271604.1, W98752.1, W59077.1,
AA009299.1, AA199237.1, AA118991.1, AL286727.1, AI122511.1, AA822533.1, AA590075.1, AA268809.1,
AA198139.1, AA051263.1, W64539.1, AW793665.1, AW484117.1, AW484121.1, H31197.1, AW528612.1, AA691124.1,
AW003500.1, AI415794.1, AU014893.1, AA606218.1, AW637653.1, AW452227.1, AA413355.1, AW739254.1,
AW346361.1, AU056737.1, AU039136.1, AU030802.1, C92913.1, C90605.1, C90570.1, AA736083.1, T67650.1,
AW844850.1, AW557138.1, AW445939.1, AW209584.1, AW191223.1, AJ273829.1, AV225068.1, AW112103.1,
AI919153.1, AU076341.1, AI888804.1, AI839037.1, AA696686.1, AA509465.1, AA377292.1, W15768.1, AC010552.3,
AC007604.1, AP001005.1, AC020707.2, AC018350.2, AC015996.2, AC016708.3, AC027373.2, AC015972.3,
AC0I6997.4, AC013404.1, AL355886.1, AL109769.2, AC012316.4, AC011712.2, AC020991.3, AC023014.2,
AC016226.1, AL354652.3, AL139334.3, AL161635.1, AL096782.3, AC044809.2, AC040951.2, AC012607.4,
AC009070.5, AC012127.2, AC009871.5, AC013456.3, AC013398.2, AL139421.3, AL020985.1, AC011606.6,
AC060757.2, AC024991.2, AC040900.2, AC026539.2, AC021546.3, AC011967.3, AC055860.1, AC007718.2,
AC019253.3, AC022959.3, AC020754.2, AC014357.1, AL356139.2
SEQ ID NO: 471
ZH1337/T3

NM_014890.1, U53445.1, Z46792.1, AC007557.3, AE001808.1, AL132949.1, AC004595.1, U60149.1, AL096867.15,
Z79758.1, AL049692.13, AL031277.1, AC015985.8, AC005834.1, AL133244.1, AL139076.2, AL021171.1, U58751.1,
AW779584.1, C05084.1, AW779587.1, AW779590.1, AW751244.1, AI606223.1, AW779641.1, AA990984.1, AI940062.1,
AV343292.1, AV089962.1, AW867011.1, AV292155.1, D75522.1, R54298.1, AW309190.1, AV194167.1, AI587990.1,
AA964335.1, AI068552.1, AA666699.1, AW467155.1, AW439057.1, AW401003.1, AW325166.1, AW322018.1,
AW168998.1, AV339384.1, AV259982.1, AW104948.1, AI988870.1, AI854627.1, AI843433.1, AI835147.1, AI765820.1,
M536969.1, AI494412.1, AA998598.1, AI429807.1, AI347598.1, AL228563.1, AI049016.1, AA629377.1, W97823.1,
U31683.1, T69472.1, AC022883.3, AC024938.7, AC069222.1, AC025231.2, AC021518.2, AL158159.3, Z92860.22,
AC025318.2, AL353144.1, AP001836.1, AC062011.2, AC022074.11, AC026699.2, AC016619.5, AC008455.5,
AC008973.3, AC008839.4, AC036108.2, AC067934.1, AC026563.2, AC0J 8999.3, ACJ025677.2, AC019139.4,
AC017103:3, AC011796.2, AC006759.3, AC006771.1, AL137244.14
SEQ ID NO: 472
ZH1337/T7

NM_014890.1, U53445.1, L16887.1, AC009294.8, AF096863.1, AF132287.1, AJ007556.1, U23850.1, L38019.1,
AB005241.1, D26070.1, AE003474.1, AE003418.1, NM_010585.1, AC004885.2, AF035831.1, AC005291.1, AC004061.1,
AL031583.2, AL021453.1, X15373.1, J05510.1, L08753.1, AC022492.5, AC006438.3, AE003811.1, AC007843.6,

TABLE 1-continued

Sequence homologies (GenBank Accession Numbers)

AC007514.5, AC007630.3, AF087414.1, AC005562.1, AF099917.1, AL158088.6, AL031666.3, AL031577.1, AL009177.1,
AL034399.6, U49947.1, X95276.1, AB005233.1, L00638.1, Z14989.1, U00731.1, AI435598.1, AI810391.1, AW303392.1,
AI435391.1, AI921737.1, AI401231.1, AI635663.1, AA576134.1, AA424880.1, AI016L21.1, AW026643.1, AW058260.1,
AI817224.1, D57964.1, M139164.1, AI086061.1, AA430212.1, M185109.1, AW295168.1, AA973230.1, AA609225.1,
AW058427.1, AA857729.1, AI394490.1, AI378381.1, AI783720.1, AI334138.1, AI701330.1, AW083745.1, AI335721.1,
AI378578.1, AI431237.1, AI804232.1, W69790.1, AI803115.1, AI013647.1, AW118656.1, AA033582.1, AW413495.1,
AA925088.1, AA258605.1, AA033581.1, AA463851.1, AI3714.63.1, AA795013.1, R78245.1, AA256689.1, AI381752.1,
P27521.1, AA710489.1, AA030472.1, D58330.1, AA568101.1, AA217400.1, D57334.1, C16405.1, AA241058.1,
C16415.1, D57996.1, AI473313.1, AA891483.1, AW346548.1, Z21882.1, AW363711.1, AA445957.1, AA986888.1,
AA204051.1, AW582813.1, F37351.1, AA266373.1, AI464359.1, AW214616.1, AV234619.1, AA432784.1, AV248227.1,
AW437163.1, T84055.1, AV229961.1, AW363682.1, AA170494.1, AA255796.1, AA463341.1, AV343730.1,
AA546804.1, AA515391.1, AI181464.1, AA930120.1, AA172829.1, AC069222.1, AC022883.3, AC024938.7,
AC023911.4, AP000812.1, AP000593.1, AC026770.3, AC020685.3, AL355315.2, AC025540.2, AC015833.3,
AC012512.2, AC024157.1, AL158161.4, AC055835.2, AC068627.4, AC027396.2, AC067833.1, AC023131.4,
AC025666.2, AC007902.2, AC016675.4, AC010014.5, AC014946.1, AC020107.1, AC010015.3, AL354827.1,
AL139133.2, AP001095.2, AC018473.10, AC012022.5, AC010189.4, AC026249.2, AC011095.3, AC024395.2,
AC068725.1, AC024566.2, AC022098.5, AC008449.4, AC010303.4, AC010628.3, AC008584.3, AC068595.1,
AC027768.2, AC012321.4, AC009032.5, AC027750.3, AC068055.1, AC031977.3, AC008718.3, AC023549.2,
AC012052.2, AC022927.2, AC022309.7, AC022829.3, AC016130.13, AC024006.2, AC007345.2 AC023180.2,
AC008342.11, AC018361.6, AC018515.2, AC021633.1, AC017903.1, AC008004.4, AL157763.2, AL356272.1,
AL161632.4, AL354669.1, AL161434.3, AL160274.2,, AL121594.2, AP000706.1
SEQ ID NO: 473
ZH1341/T3

NM_006431.1, AF026166.1, AF026293.1, NM_007636.1, Z31553.1, AB041570.1, AB022156.1, Z69239.1, AF144628.1,
AF074960.1, AC010685.3, AC004478.1, AC004225.1, AL07864.6,29, U28047.1, AJ002428.1, AE003570.1, AE003489.1,
AE003431.1, AC006060.1, U80455.1, X95840.1, M60785.1, AL031227.1, T25350.1, T06605.1, AA047132.1, C17845.1,
AA623003.1, W52697.1, T34811.1, AA045726.1, AW465425.1, T88741.1, T34157.1, AA136549.1, W00501.1,
AI316379.1, T07709.1, AA030232.1, T32083.1, T30266.1, AL024449.1, T34904.1, AI986262.1, AI970836.1, AL024385.1,
AA008392.1, AA002279.1, T36024.1, AA220807.1, AI131881.1, AA277806.1, AL121077.1, AA163893.1, AA754987.1,
W34437.1, AA151835.1, AA306144.1, AA192116.1, AA300884.1, AI084631.1, AI114754.1, H02506.1,
R11411.1, AA854925.1, AI080278.1, R25131.1, AI683290.1, W54004.1, H33330.1, AI982815.1, T06606.1, N29115.1,
AA151861.1, AI955296.1, AA051233.1, W30995.1, AA072866.1, AI992184.1, AA647081.1, I-154133.1, AA031431.1,
AI047227.1, AA634515.1, W53488.1, AW682117.1, AI342485.1, AA896241.1, AA537031.1, AA102856.1, W11223.1,
AA163616.1, W32188.1, AA474269.1, AW464207.1, AA307507.1, AA874963.1, AA096900.1, AA920985.1, W71226.1,
AA117392.1, AA198072.1, AI858401.1, AA163606.1, W76587.1, W10538.1, AW766196.1, AW079041.1, AI801143.1,
AA065626.1, AW546786.1, AW546150.1, AI070959.1, AW276472.1, W13449.1, AW646329.1, AA268234.1,
AW554539.1, AA896519.1, AW646056.1, AW640950.1, AW211726.1, AC018921.6, AC008730.4, AL049185.4,
AC010758.2, AC010941.3, AC012530.2, AL137145.5, AC017068.3, AL162735.5, AL355147.1, AC009872.3,
AC026722.3, AC022090.3, AC016553.4, AC025742.4, AC015669.4, AC024632.1, AC011898.2, AL136988.4,
AP001388.1, AC021662.8, AC015549.5, AC026314.3, AC068601.3, AC008375.6, AC008733.4, AC016085.2,
AC053486.2, AC027062.2, AC010965.6, AC009194.2, AC018583.3, AC009555.4, AC009284.2, AC020726.3,
AC011706.13, AC011267.2, AC017110.3, AC012499.3, AC022238.1, AC020525.1, AC014553.1, AC015253.1,
AC006765.1, AL133519.15, AL355295.4, AL137021.3, AL157892.4, AL353633.2, AL162416.2, AL160284.3,
AL160002.3, AL109655.4, AL121853.1, AP000858.1
SEQ ID NO: 474
ZH1342/T3

AF005067.1, AL080149.1, Z98885.1, AB033112.1, Z84485.1, NM_004634.1, AF176815.1, M91585.1, AE003841.1,
AF066970.1, AE003706.1, AE003541.1, AE001865.1, AF152364.1, AF029776.1, AL110163.1, AL035608.11,
AL009177.1, AL078635.1, AK001633.1, AB014600.1, NC_0011441 NM_014643.1 NM_005284.1, AE003672.1,.
AE003466.1, AE003441.1), NM_007168.1, AC005358.1, AF001317.1, AF023078.1)AL121578.1, U69720.1, U69719.1,
U69718.1, U69717.1, U69716.1, U24159.1, U18549.1, Z73145.1, Z73144.1, X63004.1, X63005.1, AB025284.1, L36150.1,
AB020629.1, X07985.1, Z80168.1, Z80167.1, Z80166.1, Z80165.1, Z80164.1, Z80163.1, Z80162.1, Z80160.1, X66933.1,
X66918.1, X71000.1, X70999.1, X70998.1, M31794.1, D86975.1, AL041903.1, AW176308.1, AW748208.1, H55r08.1,
AV118538.1, AA930693.1, AW369905.1, D76571.1, AJ397954.1, AW674903.1, AF034196.1, AI907910.1, T98019.1,
AI594388.1, AI551828.1, AI514970.1, AA990859.1, AA948792.1, AA615805.1, AA461239.1, AA076152.1, W94477.1,
W46356.1, W38747.1, N98297.1, H65630.1, H65071.1, R93581.1, R07789.1, T97395.1, T87592.1, AW737888.1,
AW721225.1, AW598032.1, AW398350.1, AW376978.1, AW289794.1, AW216360.1, AW132493.1, AI076494.1,
AI076474.1, AA653055.1, AA467735.1, AA448354.1, AC063971.1, AC011610.6, AC008034.14, AC066599.1,
AC018829.3, AC011610.5, AC021996.1, AC022382.1, AC008117.2, AC012738.1, AC009739.2, AC005425.3,
AC021030.5, AC068893.1, AC021031.2, AC021041.3, AC021033.2, AC022282.1, AC012285.1, AL138703.2,
AL353576.1, AC010189.4, AC008737.6, AC023592.2, AC015867.2, AC007328.4, AC020260.1, AC017435.1,
AC013251.7, AC010177.4, AC026765.5, AC023550.3, AC046185.2, AC009716.3, AC006452.3, AC026087.3,
AC016791.4, AC019001.3, AC021808.3, AC022559.3, AC015844.4, AC012109.2, AC023303.2, AC015490.3,
AC007582.6, AC016735.3, AC021979.1, AC017268.1, AC018307.1, AC016246.1, AC013388.2, AC013007.1,
AC010837.1, AC008225.2, AC008029.2, AL355372.2, AL355804.2, AL355574.2, AL353722.2, AL139820.2
SEQ ID NO: 475
ZH1342/T7

Z98885.1, AL049402.1, AF005067.1, AL080149.1, AJ276620.1, Z77661.1, AC010143.3, AE003520.1, AE001419.1,
AC004186.1, Z98551.1, AP000517.1, AB023055.1, AB023054.1, AC008082.12, AC006508.2, AC005293.1, AC002984.1,
AL163231.2, Z97348.1, AI117204.1, AL137082.1, Z92846.1, AP001686.1, AI912611.1, AA194257.1, AW511409.1,
AI350842.1, AI497969.1, AI991928.1, M061156.1, AA744999.1, AW367919.1, AI697635.1, D53392.1, AI680322.1,
H11244.1, AU021249.1, T07017.1, AW464067.1, AA675465.1, AU021226.1, H07921.1, AA675514.1, AA096761.1,
AI316859.1, AA675570.1, H11599.1, AA415581.1, AI605086.1, AV232516.1, AA140518.1, AA423260.1, AA407537.1,
L26667.1, AV308339.1, AV362645.1, AI136270.1, AV221817.1, AV232046.1, AV309058.1, AA538272.1, AV295672.1,

TABLE 1-continued

Sequence homologies (GenBank Accession Numbers)

AA881466.1, AI909924.1, AV317023.1, AI610452.1, AV272219.1, AA253945.1, AA163258.1, AW151974.1,
AA267651.1, D25843.1, AV362354.1, AA602506.1, N55893.1, T60706.1, AW731089.1, AW556255.1, AW539783.1,
AW537016.1, AV289382.1, AV288374.1, AV287917.1, AV281808.1, AW113811.1, AV171764.1, AV150903.1,
AV136562.1, AV132076.1, AV036654.1, AV033511.1, AV018891.1, AV017847.1, AV014616.1, AV012475.1,
AV004049.1, AU041826.1, AI194930.1, AI194429.1, AI158937.1, AI158907.1, AU017925.1, AI042738.1, AA880883.1,
C87705.1, C85054.1, AA146382.1, AC026436.2, AL355335.2, AC018613.3, AL355821.3, AL356099.1, AC017268.1,
AC008225.2, AC008029.2, AP001205.1, AC016938.3, AC023406.2, AC021184.2, AC019498.1, AC069202.1,
AC007383.3, AC022738.3, AC004688.6, AC019213.4, AC012299.2, AC019247.3, AC0I4L29.1, AC004709.3,
AJ009617.3, AL353748.1
SEQ ID NO: 476
ZH1349/T3

NM_014633.1, D63875.1, NM_009431.1, L49502.1, Z64358.1, Z60774.1, Z56379.1, AF106950.1, AE003734.1,
AF035396.1, NC_001136.2, U33050.2, AE003665.1, AF168787.1, AC005251.1, NM_0114.44.1, AC006932.8,
AC004600.2, AC004259.1, AC004364.1, AC003981.1, AL163293.2, AJ271782.1, U74488.1, Z78411.1, X14061.1,
AJ010604.1, X65657.1, AP001748.1, AP001629.1, AB028606.1, U03673.1, X78 854.1, AB006330.1, AI972468.1,
AL037613.1, AI956252.1, AW533634.1, AI119107.1, Z20387.1, AV126363.1, AU038895.1, AV409090.1, AW322594.1,
AV286414.1, AV047689.2, AI528773.1, AC025744.5, AC023566.3, AC009612.3, AC055874.2, AC013464.2,
AC019126.4, AC009699.6, AC011980.3, AC020573.2, AC008309.6, AC020256.1, AL136178.3, AL354753.1,
AL161645.2, AL161616.4, AP000945.2, AP000940.2, AP000914.2, AC068797.3, AC023796.17, AC044841.2,
AC068051.2, AC009682.3, AC027796.2, AC068471.1, AC027040.2, AC019005.4, AC026819.1, AC009252.8,
AC016688.4, AC011875.3, AC011678.4, AC023669.3, AC010708.9, AC011329.5, AC010I30.4, AC021758.1,
AC013765.2, AC017332.1, AC013260.1, AC012422.1, AL137250.3, AL133167.1, AL157364.1, AP001320.1,
AP000848.1, AP000663.1
SEQ ID NO: 477
ZH1349/T7

NM_014633.1, D63875.1, NM_009431.1, L49502.1, AC004796.2, NM_003670.1, AC006989.3, U78027.1, AL034370.1,
AL031007.1, AL035422.12, AB004066.1, AC025744.5, AC027377.2, AC024240.2, AC023374.2, AC010144.2,
AC060757.2, AC019025.4, AC055119.2, AC009506.3, AC009315.3, AC017073.4, AC060823.1, AF235105.1,
AC024192.2, AC021807.3, AC021192.3, AC025292.6, AC019229.4, AC015974.4, AC022184.2, AC023000.2,
AC011303.4, AC010948.2, AC009907.2, AL138772.2, AL137783.4, AL133476.4, AI140348.1, AW575179.1,
AA313178.1, AI302523.1, AI343468.1, H88182.1, AI924726.1, AL279164.1, AI675472.1, AI694570.1, C05893.1,
AI935120.1, AW573224.1, AW070842.1, W27038.1, H49849.1, AW338994.1, AW173599.1, AW192729.1, AI935109.1,
AA775398.1, AI418449.1, AA649176.1, AA977091.1, H99003.1, AI921383.1, AA111977.1, AW057891.1, N45992.1,
AA903179.1, AA725733.1, AA769208.1, AI050019.1, AA972949.1, AA907605.1, AI650806.1, AI040043.1, AA976298.1,
AA663521.1, AA599535.1, AI392652.1, W15276.1, N20975.1, AA382400.1, AI015136.1, AI830477.1, AI702518.1,
AA448303.1, AA133685.1, D62244.1, H11922.1, Z21605.1, AA883364.1, AA120987.1, H71942.1, T18935.1,
AW236770.1, H88183.1, AA970675.1, AA906369.1, AA778495.1, AA569907.1, AF074673.1, AI110766.1, T36008.1,
H49850.1, AA448439.1, H13635.1, H14826.1, H72101.1, AI882558.1, AA990321.1, AL231369.1, AA794084.1,
AW391124.1, AA126436.1, AI540567.1, AW338921.1, AW008252.1, AI983861.1, AI926982.1, AI811452.1, AI801550.1,
AI697038.1, AI692253.1, AI680537.1, AU061411.1, AL047652.1, AI384049.1, AL274740.1, AI129012.1, M050840.14,
AA935903.1, AA502930.1, AA459382.1, W39236.1, H50006.1, H47024.1, T40923.1
SEQ ID NO: 478
ZH135/T3

AB020660.1, AC004560.1, AC002335.2, AC011749.2, NM_014119.1 NM_001385.1, AC010135.3, AC004021.1,
AF090901.1, AE001806.1, AE001523.1, AF003694.1, L44117.1, AB008681.1, AB004678.1, AP000500.1, D78011.1,
NM_000206.1, NM_014892.1, AC022492.5, AC006264.3, AE003605.1, AE003528.1, AF225899.1, AC003093.1,
NM_007167.1, AC006007.1, AF191067.1, AF191066.1, AF191065.1, AF199490.1, AF055470.1, AF105999.1,
AC005599.5, AC006524.1, AL163231.2, AL023496.1, AL035684.25, AL034552.22, AL035555.10, Z93928.1,
AL243221.1, U12968.1, AP001686.1, AP001116.1, D11086.1, M59706.1, AB013356.1, AB029039.1, M60729.1,
M37157.1, AW301888.1, AI568547.1, AI583768.1, AI936629.1, W27274.1, M62235.1, AI480106.1, W25908.1,
M695267.1, AW877787.1, AW028690.1, N62788.1, AA055767.1, H35697.1, AI154653.1, AA684914.1, AI314818.1,
AW304578.1, AW701243.1, AA730316.1, W27573.1, AA747507.1, AW701235.1, AU062105.1, AU054035.1,
AU039346.1, AW779331.1, AW612623.1, AW612325.1, AW449054.1, AW271596.1, AW257923.1,
AW243196.1, AW242821.1, AW197670.1, AW028159.1, AW024860.1, AW024852.1, AI991537.1, AI936331.1,
AI912813.1, AI831914.1, M765642.1, AI672449.1, AI629008.1, AI478498.1, AI469047.1, AL291149.1, AI114808.1,
AI033077.1, AA704840.1, AA704236.1, W03786.1, N98259.1, R91017.1, AW519289.1, AW819284.1, AW768498.1,
AW768346.1, AW686186.1, AW504627.1, AW391566.1, AW211317.1, AW193466.1, AW183964.1, AV258097.1,
AW081914.1, AL110372.1, AI864987.1, AI860562.1, AI684615.1, AI440025.1, M370166.1, M091610.1, AA988240.1,
AA832000.1, AA807563.1, AA632170.1, AA447899.1, AA132727.1, AA100128.1, AA099559.1, AA054459.1, W61266.1,
N54821.1, R91111.1, Z29120.1, AL157758.5, AC016693.4, AC008574.3, AC021709.2, AC022756.2, AC021050.4,
AC055748.5, AC021818.3, AC012239.3, AC025400.2, AC024412.2, AC018097.3, AC012511.3, AC006184.1,
AL139089.4, AC068889.4, AC023509.9, AC021865.7, AC036240.3, AC013487.3, AC021158.2, AC024557.1,
AC015566.4, AC013262.3, AL353999.1, AP001011.1, AP000805.1, AC005973.4, AC034257.2, AC036184.2,
AC068914.1, AC036131.2, AC013335.5, AC010297.3, AC008722.4, AC068464.1, AC009836.3, AC024603.2,
AC026975.2, AC037428.1, AC022402.2, AC010066.5, AC014420.1, AC014889.1, AC015913.2, AC016400.1,
AC016110.1, AL139349.16, AL096865.22
SEQ ID NO: 479
ZH135/T7

AB020660.1, AC002336.2, NM_014119.1, NM_001385.1, AF090901.1, AC006365.3, AE001523.1, AB004678.1,
D78011.1, AC011504.2, AC022492.5, AE003522.1, AE003419.1, U82695.2, AC005251.1, AC003093.1, AF191067.1,
AF191066.1, AF191065.1, AC007535.3, AF007865.2, AL079352.3, AL049588.11, AL121806.2, AL034552.22,
AL132769.1, UL2968.1, M59706.1, J03498.1, AW301888.1, AI568547.1, AI583768.1, W27274.1, AI936629.1, M62235.1,
AI480106.1, AI695267.1, AW877787.1, W25908.1, AW028690.1, N62788.1, AW304578.1, AA055767.1, AA730316.1,

TABLE 1-continued

Sequence homologies (GenBank Accession Numbers)

AA747507.1, AI154653.1, H35697.1, AA684914.1, AI314818.1, AW193466.1, AW779331.1, AW612623.1, AW612325.1,
AW9054.1, AW300369.1, AW271596.1, AW243196.1, AW242821.1, AW197670.1, AW028159.1, AW024860.1,
AW024852.1, AI991537.1, AI936331.1, AI912813.1, AI831914.1, AI765642.1, AU062105.1, AI672449.1, AU054035.1,
AI629008.1, AI478498.1, AI469047.1, AU039346.1, AL291149.1, AI254569.1, AI114808.1, AI033077.1, AA764892.1,
AA704840.1, AA704236.1, AA213666.1, W03786.1, N98259.1, R91017.1, AW211317.1, AV258097.1, M998589.1,
AI377934.1, AU007984.1, AL157758.5, AC021709.2, AC022756.2, AC016796.2, AL137840.9, A0021050.4,
AC025400.2, AC024412.2, AC010243.3, AC016555.4, AC026005.2, AC036240.3, AC026131.2, AC018625.4,
AC013656.3, AC012239.3, AC022474.3, AC023168.6, AC013487.3, AC010897.3, AL139089.4, AC021645.6,
AC034257.2, AC036184.2, AC027034.7, AC068914.1, AC011454.3, AC009836.3, AC037428.1, AC012656.4,
AC034118.1, AC024431.2, AC013576.4, AC013811.3, AC023981.2, AC018699.2, AC015703.2, AC015425.1,
AC020218.1, AC007573.4, AL121905.14, AL158197.6, AP001483.1, AP001160.1
SEQ ID NO: 480
ZH1377/T3

AB006198.1, Y14314.1, AB014722.1, AB014721.1, AF129931.1, AF147725.1, L20095.1, L20680.1, AC010494.4,
AE0034931 NM_015933.1, AC011462.4, AE003765.1, AE003594.1, AC000029.17, AF161448.1, AC004825.2,
AF077202.1, U39402.1, AC004196.1, AL163296.2, AL031729.16, Z97832.11, AL049853.1, AL112418.1, AL021930.1,
AP001751.1, L09190.1, AP000510.2, AK001152.1, AP001046.1, AB023048.1, AB023212.1, M15100.1, AB017022.1,
W27222.1, AW402760.1, AL047890.1, AI594593.1, AA607769.1, AW820827.1, AI120962.1, AI509410.1, AI908693.1,
AW393484.1, AA621914.1, AW652595.1, AI964608.1, AI642054.1, AA979854.1, AA979772.1, AI661459.1, AJ228935.1,
AA751847.1, AW758324.1, AI827037.1, AV417239.1, AW615491.1, AW474981.1, AW074946.1, AW067038.1,
AW006944.1, AI924762.1, AI880663.1, AI880658.1, AI709253.1, AI708293.1, AI708235.1, F33596.1, AI666115.1,
AI570650.1, AI459983.1, AI420748.1, AI418553.1, AI370584.1, AI339191.1, AI333234.1, AL277699.1, AL268051.1,
AI140031.1, AI092938.1, AI090805.1, AI026809.1, AA995593.1, AA910393.1, AA877021.1, AA807417.1, AA804750.1,
AA742573.1, AA584264.1, AA574096.1, AA563619.1, AA527394.1, AA364686.1, AA361058.1, AA321138.1,
AA316267.1, AA284615.1, AA282382.1, AA280277.1, AA279671.1, AA229404.1, AA151350.1, AA149268.1,
AA134303.1, AA082333.1, AA071511.1, AA046848.1, AA026455.1, W95678.1, W76586.1, W51757.1, W52002.1,
W16750.1, W05408.1, W04465.1, N84053.1, N80509.1, N78206.1, N76058.1, N70547.1, N59651.1, H54880.1, R08131.1,
R07233.1, T97050.1, T91349.1, T39397.1, AP001201.4, AP000592.2, AP001191.1, AP000586.2, AC008683.4,
AC018996.3, AC046141.3, AC068951.1, AC022120.4, AC008405.3, AC008658.2, AC011069.6, AC013189.1,
AC068992.3, AC055744.2, AC027309.2, AC027307.3, AC022091.3, AC010577.4, AC008453.4, AC008450.3,
AC064317.1, AC064056.1, AC052499.1, AC044355.1, AC045178.1, AC041917.1, AC040463.1, AC034640.1,
AC028038.1, AC021328.3, AC007903.2, AC026184.1, AC018734.2, AC011233.2, AC023950.2, AC010899.3,
AC015903.1, AC014411.1, AC018045.1, AC006579.3, AL136136.2, AL136119.3, AL109955.13, AL135939.9,
AL133282.13, AL133284.12, AL032818.2
SEQ ID NO: 481
ZH1377/T7

Y14314.1, AB006198.1, AF129931.1, AB014721.1, AB014722.1, AF119856.1, AF109680.1, AF105334.1, AL137786.2,
AE003430.1, AL0331251 NM_008217.2, U86408.2, Z82068.1, AL132966.1, NM_016558.1, AF207829.1, AF204271.1,
AE003639.1, AE003541.1, AE003451.1, AE001863.1, AC005443.1, AF017113.1, U43537.1, AL136000.2, AL163652.1,
AL133445.2, AL031295.1, Z99122.1, AB026898.1, AP000498.1, Z99121.1, X83381.1, AJ233717.1, AI831753.1,
AI830I62.1, AW082054.1, AI784561.1, AI751435.1, AW296164.1, AI076937.1, AI417592.1, AI832417.1, AI418373.1,
AW471179.1, AW373854.1, R00027.1, AA873591.1, AW577472.1, AL299276.1, AA994926.1, AW193590.1,
AA719303.1, M352467.1, AA937579.1, AA150708.1, AI887024.1, AW076002.1, C15250.1, AI167599.1, C14562.1,
R62890.1, AA436728.1, W72736.1, AW652595.1, W77888.1, AI642054.1, AI024520.1, AA424118.1, AI6488601,
W26153.1, AA198906.1, AA599522.1, AA719206.1, C04465.1, AI879475.1, AI598660.1, c03203.1, AA923037.1,
R89163.1, AW823000.1, AW336989.1, AW228635.1, AA738331.1, AI190229.1, AI133253.1, T15806.1, W59275.1,
AA159334.1, AA150810.1, W08514.1, AA562404.1, AA524379.1, AI504540.1, AA535861.1, AI111403.1, AA268523.1,
AW601644.1, AI112699.1, AL228721.1, AW376834.1, AI501993.1, D82373.1, AA074115.1, AI828039.1, AI368786.1,
AA007824.1, c06261.1, AV343384.1, AA881513.1, AV225592.1, AV354003.1, AW116461.1, AA159405.1, AI643510.1,
D82306.1, AV308997.1, AL246103.1, AV316572.1, AV314799.1, AI330432.1 AI120962.1, AV314752.1, AA708028.1,
AW602080.1, T89567.1, AW581697.1, D83891.1, AV100082.1, AV097253.1, AV032808.1, AP001201.4, AP000592.2,
AP000586.2, AP001191.1, AC023849.1, AC012934.1, AL022597.5, Z92865.1, AL022596.1, AC009188.4, AC036224.2,
AC034229.2, AC011498.4, AC025882.2, AC005079.2, AC009470.3, AC026283.2, AC015938.3, AC014337.1,
AC014984.1, AC020327.1, AC005044.1, AC005459.1, AL109965.22, AL355837.1
SEQ ID NO: 482
ZH1381/T3

NM_014673.1, D14659.1, AF146342.1, AC004741.1, AC005343.1, AL049838.3, AL132668.2, NC_001224.1,
AF152364.1, AL161572.2, AJ011856.1, Z70680.1, AL031703.11, AC007878.2, AE002473.2, AE003844.1, AE003787.1,
AE003676.1, AE003519.1, AE003422.1, AE003217.1, AE002613.1, NM_011376.1, NM_008062.1, AC004926.2,
AC2005521.1, AC005004.3, AC011713.2, AC006065.3, AF044676.1, AL132641.2, AL162755.2, AL162754.2,
AL137228.2, U88534.1, AL021395.15, AL021406.1, U47058.1, U59516.1, U59515.1, L40698.1, U53501.1, U40575.1,
U41028.1, X07467.1, Z11911.1, Z84471.1, AB013484.1, M99599.1, AB020872.1, M26655.1, AL048716.3, AL038161.1,
AW204529.1, AA447858.1, AI557375.1, AA821444.1, AW583644.1, AW583578.1, AA385797.1, AA560410.1,
AA870575.1, AA301506.1, AA471359.1, C83495.1, C82639.1, AA003181.1, AI525324.1, AA163000.1, AA187086.1,
AA855729.1, AW644280.1, AW765060.1, AI156263.1, AW646028.1, AA638895.1, AA137986.1, AA545015.1,
AL204083.1, AA248265.1, AA687160.1, AW639641.1, AI555299.1, AI616839.1, AW303995.1, AI669342.1, AA530808.1,
AW209495.1, AI636359.1, AW009849.1, AI669343.1, AW548701.1, AV180860.1, AV178105.1, AV177100.1, C54380.1,
C36065.1, D34365.1, D33956.1, D33401.1, D27654.1, AW623143.1, AW623051.1, AW623049.1, AW621371.1,
AW578603.1, AW442863.1, AW229969.1, AW219265.1, AW096443.1, AW092722.1, AI921265.1, AI789557.1,
AA894979.1, AA839723.1, C79227.1, AC022634.3, AC026950.2, AC012206.3, AP002079.1, AP002078.1, AC018351.8,
AC022295.7, AC062037.2, AC017100.3, AC010149.4, AC023940.2, AC022960.2, AL35637 1.1, AU55792.1,
AC011257.3, AC025764.3, AC027423.2, AC023592.2, AC013323.5, AC015564.3, AC016105.3, AC015594.1,
AL121996.5, AL109923.21, AL355352.3, AL139190.3, AL139418.1, AL049803.1, AP001990.1, AP001974.1,
AC062004.2, AC068774.Z AC048384.2, AC026046.4, AC022414.3, AC025431.3, AC062001.1, AC024031.2,

TABLE 1-continued

Sequence homologies (GenBank Accession Numbers)

AC025003.2, AC0229973, AC018793.4, AC021134.4, AC016035.3, AC011568.3, AC021225.3, AC011855.2,
AC012390.5, AC015675.1, AC012142.1, AC008227.2, AC007905.1, AL356355.2, AL353092.3,
SEQ ID NO: 483
ZH1381/T7

NM_014673.1, D14659.1, AC004492.1, AC009233.3, Z99133.1, AF178030.1, AC004838.2, AF048726.1, AL109654.22,
AL031430.1, AJ243213.1, AL138651.1, AL033392.5, Z81364.1, AC006231.18, AC005875.2, AC007421.12, AF028834.1,
AL160191.2, Z99135.1, AJ232463.1, AJ232461.1, AJ232460.1, AJ232459.1, AJ232458.1, AJ232456.1, AJ232466.1,
AJ232465.1, AJ232464.1, AJ232454.1, AJ232501.1, AJ232462.1, AL117340.3, L31948.1, AC0I9209.3, AE003578.1,
AE003426.1, AC006229.17, AC006472.1, AC004802.1, AL110292.4, AL163219.2, AL034556.3, AP001674.1,
AP000477.2, AC009478.4, AC006332.3, AE003518.1, AE003507.1, AC007151.2, AF030694.2, AC006150.2,
AC005185.1, AC004609.1, AC004075.1, AC002412.1, AL163214.2, AL121808.2, AL136296.2, Z95116.1, AL022159.1,
AP001669.1, U07978.1, AI636359.1, AI669343.1, AI669342.1, AI566150.1, AI027953.1, AW276600.1, AI339009.1,
AA447703.1, AII147898.1, AA887811.1, AI679455.1, AA873375.1, AA836064.1, AA534251.1, AI422353.1, AA745251.1,
AW130877.1, AA708596.1, AW168287.1, AW303995.1, AI420890.1, AI677854.1, AA935810.1, AA938493.1,
AA687160.1, AA311297.1, T27967.1, AA301507.1, AA935814.1, AA447858.1, N50202.1, AA683177.1, AW009849.1,
AA545015.1, AI555299.1, AA137986.1, N68048.1, AA530808.1, AW198055.1, AW592606.1, AA181333.1, AW209495.1,
AI104356.1, AA855729.1, AA638895.1, AA893851.1, AI014068.1, AL234816.1, AL204083.1, AA067766.1, AW123869.1,
AI557375.1, AW539200.1, AI556341.1, AII102630.1, AV171265.1, AI156263.1, AW204529.1, AA560410.1,
AW646028.1, L26817.1, AW764367.1, AA469099.1, AA797564.1, AI843449.1, AV250940.1, AV359988.1, AV260102.1,
AV257129.1, AV256840.1, AV253184.1, AV251229.1, AV249657.1, AW124329.1, AV156582.1, AV172897.1,
AV152635.1, AV151001.1, AV127867.1, AV122251.1, AV113481.1, AV088039.1, AV087948.1, AV087721.1,
AV060620.1, AV058322.1, AV056999.1, AV048088.2, AV015847.1, D19285.1, Z36450.1, AV033019.1, AV085824.1,
AV127868.1, AV040300.2, AV129270.1, AV120629.1, AV060547.1, AA286921.1, AC022634.3, AC019351.3,
AC025826.1, AL138828.4, AC058784.2, AL354717.1, AC068992.3, AC053499.2, AC011192.2, AC018608.4,
AC023075.2, AC016437.2, AL158149.3, AL138974.2, AL139234.1, AC069066.1, AC026105.4, AC008705.4,
AC011369.3, AC027212.2, AC026523.2, AC024736.3, AC010819.4, AC024640.2, AP000878.1, AC010176.7,
AC026119.5, AC023757.4, AC027567.2, AC023666.3, AC027073.2, AC025999.3, AC025380.2, AC004688.6,
AC008182.1, AL162715.3, AL354836.1, AL162738.2, AL353789.1, AC009772.4, AC012293.9, AC015583.6,
AC067946.2, AC008794.6, AC008396.4, AC051662.2, AC068360.1, AC010773.4, AC068065.1, AC066694.2,
AC025846.2, AC015825.4, AC011273.3, AC019267.3, AC011154.3, AC015967.5, AC011936.4, AC022926.2,
AC018835.3, AC024625.1, AC010105.4, AC020515.1, AF165178.1, AC006889.2, AL355978.2, AL356254.1,
AL158214.3, AL049181.4, AP001489.1, AP001316.1, AL020987.1
SEQ ID NO: 484
NGO-Pr-102, Mitochondrion AC022634.3, AC019351.3, AC025826.1, AL138828.4, AC058784.2, AL354717.1, AC068992.3, AC053499.2,
AC011192.2, AC018608.4, AC023075.2, AC016437.2, AL158149.3, AL138974.2, AL139234.1, AC069066.1,
AC026105.4, AC008705.4, AC011369.3, AC027212.2, AC026523.2, AC024736.3, AC010819.4, AC024640.2,
AP000878.1, AC010176.7, AC026119.5, AC023757.4, AC027567.2, AC023666.3, AC027073.2, AC025999.3,
AC025380.2, AC004688.6, AC008182.1, AL162715.3, AL354836.1, AL162738.2, AL353789.1, AC009772.4,
AC012293.9, AC015583.6, AC067946.2, AC008794.6, AC008396.4, AC051662.2, AC068360.1, AC010773.4,
AC068065.1, AC066694.2, AC025846.2, AC015825.4, AC011273.3, AC019267.3, AC011154.3, AC015967.5,
AC011936.4, AC022926.2, AC018835.3, AC024625.1, AC010105.4, AC020515.1, AFI65178.1, AC006889.2,
AL355978.2, AL356254.1, AL158214.3, AL049181.4, AP001489.1, AP001316.1, AL020987.1, AI133129.1, AI174835.1,
AA837506.1, AII174687.1, AA845434.1, AI114646.1, AA608740.1, AA658828.1, AA828080.1, AA808070.1,
AA857455.1, AA773323.1, AI133174.1, AA583915.1, AII110847.1, AA904301.1, AW476695.1, AA456337.1,
AL038877.1, AA633895.1, AL048271.1, AA808161.1, AA630140.1, C18439.1, AA507255.1, AA805233.1, AL207408.1,
AA984203.1, AI571104.1, AII174794.1, AA156220.1, AA553443.1, AA176583.1, AA856778.1, AA650251.1,
AA176822.1, AI814544.1, AA736437.1, AI174730.1, AA467942.1, AI557498.1, AW772675.1, AA564555.1, AI718315.1,
AA886828.1, AA689243.1, AA630233.1, AA897055.1, AA575992.1, AA661906.1, AA577503.1, AA548340.1,
AI133039.1, AA602775.1, AI832559.1, AA193235.1, AA131048.1, AA595999.1, AA075714.1, AA757434.1, AL036895.3,
AA582747.1, AA209389.1, AA196849.1, AA582810.1, AI685974.1, AL208586.1, AA548826.1, C18291.1, AI557663.1,
AI133693.1, AL047524.1, AA548207.1, AA889509.1, AA192336.1, AA595509.1, AI557433.1, AA679483.1, M557309.1,
AA554794.1, AA516479.1, AA143798.1, AI114473.1, AA548920.1, AA860683.1, AA614220.1, AA554088.1,
AA548557.1, AII174817.1, C17039.1, AW867453.1, AL038831.2, AA595385.1, AA402635.1, AW867465.1, AW849013.1,
AL285116.1, AA514820.1, AA554459.1, AW607854.1, AC021965.3, AC008670.3, AL161450.4, AC018856.3,
AC013437.3, AC066616.2, AC025429.2, AC021755.4, AC011821.4, AC013297.4, AC016052.2, AC022827.2,
AC023374.2, AC022861.2, AC067925.1, AC021473.3, AC012363.1, AC021835.3, AC025395.2, AC007595.3,
AC068981.1, AC021753.3, AC023652.3, AC016760.3, AL354751.2, AC009658.5, AC025916.2, AC012128.3,
AC009907.2, AL138765.3, AL355177.1, AL355176.1, AC006393.6, AL133513.2, AC034300.2, AC019324.3,
AC007670.2, AC012433.5, AP001499.1, AC025643.3, AC002987.1, AL160052.3, AC022148.4, AC011419.4,
AC008586.4, AC026918.2, AC060234.2, AC011965.3, AC035139.3, AC023387.2, AC009882.3, AC034206.1,
AC015948.3, AF205591.1, AC005848.1, AL355348.3, AL158831.5, AC002490.1, AL354696.1, AL160009.3,
AL157712.2, AL353731.1, AL138690.3, AP001453.1, AP001205.1, AP000867.1, AP000573.2, AP000424.1
SEQ ID NO: 485
ZH1291/T3

NC_001807.2, J01415.1, X93334.1, V00662.1, X62996.1, X54629.1, L084.41.1, D38112.1, NM_000256.1, Y 10129.1,
X84075.1, NC_001644.1, D38116.1, AF004341.1, X933351 NC_001643.1, D38113.1, NC_001645.1, X93347.1,
D38114.1, AF134583.1, NC_002082.1, X99256.1, NC_00164.6,1, D38115.1, NC_002083.1, X97707.1, Z79419.1,
Z79403.1, Z79459.1, AJ252237.1, U35430.1, AF030463.1, AF030273.1 NC_001602.1, X72004.1, NC_001601.1,
X72204.1, AL163203.2, AL050302.2, AL0499112 NC_002078.1, AF030460.1, AF030459.1, Y18475.1, NC_0018211
Y11832.1, U01924.1, M85148.1, AF030279.1, AF030278.1, AF030277.1, AF030275.1, NC_001567.1, JV00654.1,
NC_0019921 NC_001321.1, AF030276.1, X61145.1, Y18001.1, AF030467.1, NC_0020091
AF030458.1, AF061340.1, Y19192.1, J014351 NC_000934.1, AF030466.1, AJ224821.1 NC_001808.1, Y07726.1,
NC_000890.1, AB015962.1, NC_0016651 AF030464.1, M27315.1, X14848.1, NC_0008861 AB012104.1,

TABLE 1-continued

Sequence homologies (GenBank Accession Numbers)

NC_001913.1, AI001588.1, NC_001640.1, X79547.1, L01700.1, AF030462.1, AB042523.1, AB042524.1, AB042432.1,
AF030272.1, AF030472.1, AF030271.1, AF030489.1, AF030274.1, AF168103.1, AF030473.1, NC_001325.1, X63726.1,
AF168095.1, AL037681.3, AL038791.2, AI174902.1, AI174754.1, AI133672.1, AI133286.1, AI114699.1, AI114569.1,
AI114553.1, AI133302.1, AL048390.1, AI133486.1, AI557258.1, AI111183.1, AI766340.1, AI174851.1, AA737196.1,
AA736456.1, AI133013.1, AA652417.1, AA593688.1, AA581699.1, AA563780.1, AA526831.1, AA172073.1,
AA575833.1, AW027357.1, AL036838.3, AA648603.1, AA599168.1, AA582799.1, AA555226.1, AA551039.1,
AA514972.1, AA575830.1, AA574324.1, AA085983.1, AA075391.1, AW029484.1, AI709043.1, AA723026.1,
AA631499.1, AA629984.1, AA587808.1, AA579760.1, AA554729.1, AA196384.1, AL036246.3, AA642990.1,
AI133348.1, AA595314.1, AA578591.1, AL207615.1, AA593715.1, AA490067.1, AI863904.1, AI133323.1, AA639334.1,
AA161487.1, AI721239.1, AL285534.1, AL279442.1, AA886649.1, AA738012.1, AA586605.1, AA583348.1, AA581810.1,
AA603127.1, AI707535.1, AA548197.1, AI720161.1, AI174301.1, AI147501.1, AA640938.1, AA548398.1, AA195996.1,
AI833205.1, AA641109.1, AA526496.1, AA174081.1, AW149525.1, AI749163.1, AI720981.1, AI565971.1, AL280900.1,
AA565769.1, AA604611.1, AA736459.1, AA582715.1, AA196392.1, AA178939.1, AW027020.1, AI720842.1,
AA643267.1, AI814650.1, AA583501.1, AI709143.1, AI720252.1, AI719365.1, AI970662.1, AC012092.3, AC021965.3,
AL157387.1, AC068619.1, AC009573.3, AC044785.1, AC021029.3, AC021035.3, AL355819.2, AL163540.3,
AL354822.1, AC011821.4, AC013297.4, AC016052.2, AC009960.4, AC000382.1, AC016050.3, AC025431.3,
AC007595.3, AL137218.1, AC016147.7, AC026079.2, AC067925.1, AC021473.3, AC022192.2, AC027762.2,
AC013632.3, AC066616.2, AC027471.2, AC024454.2, AC024170.1, AC024975.2, AC025395.2, AL162611.4,
AC024253.3, AL353626.1, AC012363.1, AC022600.1, AL354697.4, AL354817.3, AC036170.2, AC025678.2,
AC009714.3, AC021822.3, AL161450.4, AL158147.4, AL161614.4, AC066596.1, AC013437.3, AL355304.3,
AL162272.3, AL137244.14, AC022861.2, AC006393.6, AL162726.3, AC058808.1, AC018890.3, AC068239.1,
AC068179.1, AL118520.15, AL354751.2, AC027456.2, AC068010.1, AC010388.4, AC020688.3, AC009577.3,
AC021821.3, AC040973.2, AC041013.2, AC021076.3, AC036102.2, AC026839.2, AC025986.2, AC013799.3,
AC005507.6, AC013452.3, AL139232.4
SEQ ID NO: 486
ZH1291/T7

AL163203.2, AL049911.2, AL050302.2, AC020663.1, AL031651.33, AL109952.15, AC005839.1, AC000095.3,
AC007957.35, AC011450.4, AQ122073.13, AC008101.15, U91326.1, AC004854.2, AC005157.1, AC005231.2,
AC009320.7, AC002544.1, AF111169.2, AC007193.1, AC007191.1, ACJ006953.1, AC000015.2, AC005952.1,
AC005954.1, AC005722.1, AC005772.1, U37672.1, AC005612.1, AC005152.1, AC003104.1, AC004560.1, AC003051.1,
AL034555.2, AL133249.1, AL049839.3, AL080242.11, AL096762.5, AL096702.10, Z93024.1, Z82097.1, AL022336.1,
AL022313.1, AL022238.1, AL022311.5, AL009183.10, AL034410.8, AL009051.1, AL021397.1, AL034394.2,
AL031311.1, AL109753.9, Z73359.1, Z73360.1, AP000966.2, AP000557.2, AP000556.2, AF156673.1, AC005137.1,
AC009363.4, AC003999.1, AC004740.1, AC004935.1, AC005102.1, AC009516.19, AF129756.1, AC007283.3,
AC006138.1, AC005884.1, AC004477.1, AC005031.1, AC004771.1, AC005330.1, AC005177.1, AC004752.1,
A0002312.1, AC000379.1, AL109984.14, AC000393.1, AL132774.20, AL133297.1, AL031428.9, AL050348.20,
AL096703.14, AL050312.8, AL033543.6, AL031846.2, Z74617.1, Z95125.1, AL033376.17, M89651.1, AP0005I3.1,
AP000688.1, AP000177.1, AP000558.1, AP000101.1, AL035072.16, AL033517.1, Z69918.1, AP000548.1, AW170035.1,
AW373574.1, AA829065.1, AI637628.1, AI570010.1, AI537590.1, AA773989.1, AA230128.1, AA169163.1,
AW849803.1, AW514811.1, AW305371.1, AW275623.1, AW131043.1, AI783494.1, AI750173.1, F17555.2, AI475857.1,
AL247199.1, AI124706.1, AA912287.1, AA659608.1, AA631507.1, AA508104.1, AA502532.1, AA501872.1,
AA468784.1, AA426451.1, AA283005.1, AA133936.1, W32063.1, N64037.1, N51020.1, N40815.1, H63092.1, R49657.1,
T16844.1, AW370598.1, AA659409.1, AA186898.1, H39920.1, R72342.1, T93314.1, AW081941.1, AA989349.1,
AA470559.1, AA457651.1, AA161492.1, AI094108.1, AA857601.1, AA662926.1, AA527286.1, N59569.1, N29751.1,
F02740.1, AW008651.1, AW007933.1, AA700038.1, AA639250.1, AA595520.1, AA401945.1, AA292700.1, AA285066.1,
AW051429.1, AW016442.1, AI904811.1, AL249150.1, AA766310.1, AA635049.1, AA506458.1, AA281435.1, R07361.1,
AI391736.1, AA748722.1, AA486063.1, N50735.1, H68177.1, AW504900.1, AW293621.1, AW274925.1, AW081375.1,
AI990487.1, AI978583.1, AI950451.1, AI808248.1, AA595803.1, AA470087.1, AA459150.1, AA369383.1, W38454.1,
W24925.1, R42480.1, R34154.1, F02835.1, F02756.1, T28100.1, AA508772.1, AA244026.1, W15152.1, F02836.1,
AL157387.1, AC067940.2, AC010336.5, AC024700.3, U82213.1, AC053496.2, AC010553.4, AC0L2184.3, AC018557.4,
AC011655.4, AC007181.1, AL354932.4, AL137854.2, AC060826.2, AC068525.1, AC008533.5, AC021221.3,
AC015845.4, AC022286.4, AC069250.1, AC069249.1, AC055839.2, AC027178.3, AC064834.2, AC026046.4,
AC024584.4, AC020904.5, AC010649.5, AC010503.5, AC010311.7, AC010449.4, AC008828.3, AC021573.4,
AC009244.20, AC011523.2, AC011516.2, AC011495.3, AC010321.4, AC009107.6, AC068105.1, AC011962.2,
AC027095.2, AC026771.2, AC022470.4, AC016700.2, AC036198.1, AC034115.1, AC025958.2, AC018999.3,
AC018389.3, AC011853.3, AC015775.3, AC023043.2, AC018566.4, AC015726.3, AC025090.2, AC019220.2,
AC023273.3, AC0) 1037.3, AC013648.3, AC023470.2, AC021154.3, AC018803.2, AC017052.4, AC016801.2,
AC012548.3, AC022382.1, AC011999.3, AC005096.1, AL356128.2, AL132867.12, AL160414.6, AL136108.3,
AP000933.2, AC021026.4, AC023332.3, AC016739.2, AC026689.3, AC010602.4, AC016561.5, AC008477.4,
AC011559.2, AC026539.2, AC004906.2, AC041028.1, AC032039.1, AC018579.4, AC023989.2, AC022596.3,
AC007219.1, AC024305.1, AC015727.3, AC010148.4, AC018745.2, AC016164.1, AL354878.2, AL162272.3,
AP001020.1, AC016923.7, AC023369.2
SEQ ID NO: 487
ZH1346/T3

AK000624.1, NC_001807.2, J01415.1, X93334.1, V00662.1, X62996.1, D38112.1, NC_001644.1, D38116.1, AJ270690.1,
X933351 NC_001643.1, D38113.1, L00016.1, X93347.1 NC_00I645.1, D38114.1 NC_002083.1, X97707.1,
NC_001646.1, D38115.1, Y17178.1, S80990.1, Z60371.1 NC_002082.1, X99256.1, X93345.1, X93344.1, V00672.1,
Y17176.1, V00658.1, X89845.1, Y17173.1, Y17180.1, Y17172.1, U92964.1, V00675.1, U92965.1, U92962.1, U92963.1,
U92967.1, U92961.1, U92969.1, U92953.1, U92952.1, U92958.1, U92968.1, U92954.1, U92960.1, U92959.1, U92957.1,
U92970.1, U92950.1, NC_001992.1, U92956.1, Y18001.1, U92955.1, U92951.1, U92966.1, Y16707.1, X91844.1,
X89767.1, X95677.1, V00659.1 NC_001325.1, AF053695.1, X63726.1, NC_001601.1, X72204.1, AF053696.1,
AF053697.1, U88283.1, AF053694.1, NC_000845.1, AF034253.1, AJ002189.1, NC_001567.1, U96639.2, J01394.1,
NC_002008.1, V00654.1, D85282.1, NC_001788.1, X97337.1, NC_0017791 NC_001700.1, U20753.1, X97336.1;
NC_001794.1, Y10524.1, NC_0016021 X72004.1, NC_001808.1, NC_001640.1, Y07726.1, X79547.1, AC007283.3,
AF053686.1, D85291.1, L32587.1, AI133129.1, AI174835.1, AI114646.1, AA583915.1, AA837506.1, AA828080.1,

TABLE 1-continued

Sequence homologies (GenBank Accession Numbers)

AW476695.1, AA456337.1, AI174687.1, AA845434.1, AL038877.1, AA608740.1, AA658828.1, AA808070.1,
AL207408.1, AA984203.1, AA857455.1, AA773323.1, AI174794.1, AI133174.1, AI110847.1, AA176583.1, C18439.1,
AA904301.1, AI814544.1, AL048271.1, AA856778.1, AA633895.1, AI174730.1, AA630140.1, AI557498.1, AA553443.1,
AW772675.1, AA564555.1, AA507255.1, AA808161.1, AA661906.1, AA886828.1, AA176822.1, AL036895.3,
AA209389.1, AI832559.1, AA805233.1, AI685974.1, AL208586.1, AI571104.1, C18291.1, AI133693.1, AL047524.1,
AA595999.1, AA156220.1, AA595509.1, AA582810.1, AI114473.1, AI174817.1, AA650251.1,
AA209315.1, AL285116.1, AL047614.1, AI581393.1, AA180770.1, AA552811.1, AA226486.1, M525583.1, AA639252.1,
AA196849.1, AA679483.1, AA876588.1, AA736437.1, AW576921.1, AA532961.1, C17039.1, AA194666.1, AA600750.1,
AA689243.1, AA602775.1, AI557433.1, AA574219.1, AA548826.1, AA467942.1, AI969525.1, AW849013.1, AI718315.1,
AW583904.1, AI628700.1, AA630233.1, AA548920.1, AA897055.1, AA575992.1, AA196582.1, AA729456.1,
AA640698.1, AA577503.1, AA084473.1, AI041369.1, AA131048.1, AW516084.1, AA554459.1, AW607854.1,
AC021965.3, AC008670.3, AL161450.4, AC018856.3, AC013437.3, AC066616.2, AC025429.2, AC021755.4,
AC011821.4, AC013297.4, AC016052.2, AC022827.2, AC023374.2, AC022861.2, AC067925.1, AC021473.3,
AC012363.1, AC021835.3, AC025395.2, AC007595.3, AC068981.1, AC021753.3, AC023652.3, AC016760.3,
AL354751.2, AC009658.5, AC025916.2, AC012128.3, AC009907.2, AL138765.3, AL355177.1, AL355176.1,
AC006393.6, AL133513.2, AC034300.2, AC024468.2, AC019324.3, AC007670.2, AC012433.5, AP001499.1,
AC025643.3, AC002987.1, AL160052.3, AC022148.4, AC011419.4, AC008586.4, AC026918.2, AC011965.3,
AC023387.2, AC009882.3, AC034206.1, AC013334.6, AC015948.3, AC018900.3, AF205591.1, AL355348.3,
AL158831.5, AC002490.1, AL354696.1, AL160009.3, AL157712.2, AL353731.1, AP001205.1, AP000867.1, AP000424.1
SEQ ID NO: 488
ZH1346/T7

AK000624.1, NC_001807.2, J01415.1, X93334.1, V00662.1, X62996.1, D38112.1, A3270690.1, L00016.1, NC_0016441
D38116.1, X93335.1 NC_001643.1, D38113.1, X93347.1 NC_001645.1, D38114.1, X93345.1, X93344.1, NC_0016461
V00672.1, D38115.1 NC_002083.1, X97707.1, V00658.1, Y17176.1, S80990.1, V00675.1, Z60371.1, Y17173.1,
X91844.1, Y17180.1, Y17172.1, Yl7178.1, NC_002082.1, X99256.1, Y16707.1, X95677.1, U92950.1, U92964.1,
U92965.1, V00659.1, X89767.1, D85282.1, U92969.1, U92967.1, M22651.1, X92954.1, U92953.1, U92952.1, D85268.1,
U92968.1, M22650.1, D85271.1, AF053696.1, U92970.1, U92966.1, D85269.1, D85270.1, U88283.1, U92955.1,
U92963.1, U929611 NC_001992.1, Y18001.1, AF053697.1, AF053695.1, AF053694.1, U88291.1, NC_001779.1,
X97336.1, D85281.1, U88292.1, U92962.1, NC_001794.1, Y10524.1, NC_001788.1, X97337.1, D85284.1, NC_001808.1,
Y07726.1, D85291.1 NC_001325.1, X63726.1, NC_001640.1, X79547.1, NC_001602.1, X72004.1, AJ002189.1,
U88256.1, NC_000845.1, AF0342531 NC_000889.1, U88268.1, U88266.1, U88261.1, U88258.1, U88255.1, AJ010957.1,
AF053686.1, AI174687.1, AA837506.1, AA608740.1, AI133174.1, AA857455.1, AA773323.1, AI110847.1, AI133129.1,
AA904301.1, AA845434.1, AA828080.1, AA633895.1, AA808070.1, AA658828.1, AA808161.1, AL048271.1,
AA805233.1, C18439.1, AA630140.1, AA507255.1, AI571104.1, AA156220.1, AL038877.1, AI174835.1, AA650251.1,
AA553443.1, AA176822.1, AA736437.1, AA467942.1, AA456337.1, AA630233.1, AA897055.1, AI718315.1,
AA577503.1, AA548340.1, AA689243.1, AI133039.1, AI114646.1, AA575992.1, AA856778.1, AA602775.1,
AA193235.1, AA757434.1, AA131048.1, AA075714.1, AA582747.1, AA595999.1, AA583915.1, AA196849.1,
AA548826.1, AI557663.1, AA548207.1, AA582810.1, AA192336.1, AI557309.1, AA889509.1, AA554794.1,
AA143798.1, AA886828.1, AA614220.1, AA514865.1, AA554088.1, AA548920.1, AA548557.1, AA679483.1,
AW867453.1, AA860683.1, AA563755.1, AL038831.2, AW867465.1, AA595385.1, AA402635.1, C17039.1,
AW849013.1, AL207408.1, AA514820.1, AA575938.1, AA477645.1, AA194768.1, AI920879.1, AA554459.1,
AA404596.1, AA487619.1, AA613098.1, AA574219.1, AA194926.1, AW867621.1, AA757912.1, AI581393.1,
AA564555.1, AL285116.1, AA876588.1, AA532961.1, AI735435.1, AA604312.1, AA486862.1, AW419471.1,
AA582107.1, AA608573.1, AC021965.3, AC008670.3, AC025429.2, AC021755.4, AC011821.4, AC013297.4,
AC016052.2, AC022827.2, AC012363.1, AC2007595.3, AC068981.1, AC023652.3, AC021753.3, AC067925.1,
AC021473.3, AC018856.3, AC012128.3, AC013437.3, AL138765.3, AC023374.2, AC022861.2, AC066616.2,
AC025395.2, AC021835.3, AL161450.4, AL355177.1, AL355176.1, AC006393.6, AC016760.3, AL354751.2,
AL133513.2, AC012433.5, AP001499.1, AC034300.2, AC019324.3, AC007670.2, AC002987.1, AL160052.3,
AC025643.3, AC022148.4, AC011419.4, AC008586.4, AC026918.2, AC060234.2, AC011965.3, AC035139.3,
AC023387.2, AC009882.3, AC034206.1, AC015948.3, AF205591.1, AC005848.1, AL158831.5, AC002490.1,
AL354696.1, AL160009.3, AL157712.2, AL138690.3, AP001453.1, AP001205.1, AP000867.1, AP000573.2
SEQ ID NO: 489
G PROTIEN PATHWAY SUPPRESSOR 1, (gps1)

NM_004127.2, U20285.2, X87885.1, AE003519.1, AF129080.1, AL133469.1, X86780.1, AC002059.3, AC000026.3,
NM_001127.1, L13939.1, U36256.1, AE003486.1, AC016795.4, U48889.1, AC020626.6, AE003571.1, AE003463.1,
AF162681.1, AC005342.1, U66722.1, AF029395.1, AL110479.1, AL242980.1, U40726.1, U40725.1, U40724.1, U40723.1,
U40721.1, 371660.1, AJ243806.1, U71124.1, Z92530.1, Y09870.1, AA315980.1, AL046753.1, AA308668.1, AA776140.1,
AW379968.1, AW379969.1, AA794667.1, AW401492.1, R22366.1, AW250694.1, AI195918.1, AW250541.1, R33383.1,
Z44978.1, Z45804.1, AA627685.1, AA972517.1, AW414640.1, AW379955.1, H12155.1, AA492726.1, AW748739.1,
AA337940.1, W65922.1, R73336.1, AW660352.1, AA870416.1, AF031560.1, AA170086.1, AW491649.1, AA026010.1,
AW806517.1, AA065408.1, R75 578.1, AA109188.1, AA368286.1, AA688596.1, AW674959.1, AA051022.1,
AA330082.1, AW248164.1, AA302223.1, C83545.1, C82689.1, W17566.1, AW423128.1, W69617.1, AA865730.1,
AA445357.1, AA279618.1, H32851.1, AI958622.1, AW462925.1, AW175196.1, W09671.1, AA979613.1, AW147429.1,
AI035492.1, AA166156.1, AA062100.1, AI496702.1, AW213099.1, AA815807.1, AA210626.1, W89993.1, AA517695.1,
AI194303.1, AW357953.1, AI693878.1, AI617037.1, AL258459.1, AI525953.1, AI979966.1, AC015708.3, AL353692.3,
AC015160.1, AC020611.4, AC026114.6, AC020879.2, AC016919.5, AC026832.2, AC068451.1, AC063964.1,
AC024460.2, AC025553.2, AC024258.1, AC017158.1, AL356245.1, AC016932.4, AC055706.3, AC069027.3,
AC068583.1, AC026953.2, AC053468.1, AC023414.2, AC037432.1, AC007643.2, AC020690.4, AC019163.3,
AC018804.2, AC010884.4, AC020509.1, AC014559.1, AC004630.2, AL353719.3, AL158037.6, AL138875.3,
AL356100.1, AL157404.2, AL161897.3, AL162311.1, AL157757.1, Z98855.1, AP001372.1, AP001095.2
SEQ ID NO: 490
ZH057/T3

NM_004127.2, U20285.2, X87885.1, AE003519.1, AF129080.1, AL133469.1, X86780.1, AC002059.3, AC000026.3,
NM_001127.1, L13939.1, U36256.1, AC016795.4, U48889.1, AC020626.6, AE003463.1, U66722.1, AF029395.1,

TABLE 1-continued

Sequence homologies (GenBank Accession Numbers)

AJ242980.1, AJ243806.1, U71124.1, AL046753.1, AW379968.1, AW379969.1, AW401492.1, AW250694.1, AA776140.1,
Z44978.1, AA315980.1, Z45804.1, AA627685.1, AW379955.1, H12155.1, AI195918.1, AA337940.1, AA794667.1,
W65922.1, AW660352.1, AA308668.1, AA870416.1, AA170086.1, AA026010.1, R33383.1, AW806517.1, AA065408.1,
AW491649.1, R22366.1, AF031560.1, AA688596.1, AW674959.1, AA330082.1, AW248164.1, AA368286.1, C83545.1,
C82689.1, AW423128.1, W69617.1, AA492726.1, H32851.1, AI958622.1, AW462925.1, R75578.1, AW175196.1,
AW414640.1, AA979613.1, AA166156.1, AI496702.1, AA815807.1, AA210626.1, AI194303.1, AW357953.1,
AL258459.1, AW584802.1, AW584801.1, AI979966.1, AI073824.1, AW459926.1, AA566237.1, D26329.1, AW680375.1,
AI855 245.1, AI855218.1, AI855212.1, AI734700.1, AA524064.1, W59814.1, W29472.1, AC015708.3, AL353692.3,
AC015160.1, AC020879.2, AC016919.5, AC026832.2, AC068451.1, AL356245.1, AC055706.3, AC027568.2,
AC024190.2, AC007643.2, AC018804.2, AC020509.1, AC004630.2, AL353719.3, AL158037.6, AL138875.3,
AL356100.1, AL157404.2, AL161897.3, AL162311.1, AL157757.1
SEQ ID NO: 491
ZH057/T7

U20285.2, NM_004127.2, X87885.1, J05517.1, NM_007438.1, AL133445.2, X03797.1, Y00516.1, AC010510.6,
AC007314.3, AL136059.2, AL031780.1, Z16710.1, AF144093.1, AC006449.19, AF034136.1, AF064749.1, AL163238.2,
AL137716.1, AL031721.1, Z98257.1, AL078630.1, M36535.1, M17843.1, AP001693.1, AP001340.1, D00451.1,
D00185.1, D00361.1, AI056387.1, AA573934.1, AW247126.1, AI669053.1, AW167515.1, AI685726.1, AI479985.1,
AI859762.1, AW732050.1, AI567797.1, AA595162.1, AI458542.1, AI377236.1, AA604679.1, AI961737.1, AI951858.1,
AI743281.1, AL202810.1, AI139695.1, AI564292.1, AA662524.1, AI513703.1, AI131335.1, AA583446.1, AA807224.1,
AI492268.1, AL299166.1, AA272746.1, AA994505.1, AA988395.1, AA521025.1, AW246831.1, AI799551.1, AI952561.1,
AI521316.1, AA569807.1, AA716051.1, AA580208.1, AA988396.1, AI810703.1, AA994504.1, AA969251.1, AI928074.1,
AA657992.1, AA931856.1, AI091930.1, AA847278.1, AW188344.1, AI796670.1, AA749404.1, AI272794.1, F24930.1,
AI471309.1 AI825867.1, F24931.1, AA757891.1, AA708597.1, AA974663.1, AA732155.1, AL240890.1, AI885726.1,
AI638230.1, AI871463.1, AA766100.1, AI090239.1, AW249881.1, AA280965.1, AI808546.1, AA434157.1, AL285895.1,
AW474426.1, AW189219.1, AA913078.1, AW674940.1, AW300960.1, AI868353.1, AI470209.1, AA923622.1,
AW166880.1, F25087.1, AA481945.1, W79901.1, R73316.1, AW513345.1, AW592528.1, AI818261.1, AI870480.1,
AI354982.1, AW591711.1, AI934744.1, AI458656.1, AW073126.1, AI925790.1, AI360724.1, AA309009.1, AW304052.1,
AA993663.1, AW651615.1, AA862926.1, AW316592.1, AC015708.3, AL353692.3, AC023254.3, AL355837.1,
AC010180.4, AC048382.2, AC037456.4, AC009477.3, AC025698.3, AC022922.2, AC023091.2, AC015784.2,
AC020645.2, AL355365.2, AL161437.5, AL133261.5, AL136147.2, AF00t 766.1, AC068800.3, AC067739.3,
AC025154.4, AC023276.3, AC068679.1, AC044792.2, AC040159.2, AC011352.3, AC011402.5, AC008615.4,
AC011499.2, AC027622.3, AC026657.3, AC027098.2, AC040950.1, AC021152.3, AC015960.4, AC018435.3,
AC025684.2, AC022190.3, AC022050.2, AC025361.2, AC011032.3, AC021534.3, AC025834.1, AC011224.5,
AC024333.2, AC018580.4, AC024628.2, AC017108.2, AC015864.1, AC010136.3, AC016811.2, AC009798.2,
AC004676.1, AL139420.2, AL157902.2, AL139119.5, AL121759.19, AL139004.3, AL355514.1, AL353801.2,
AL161900.3, AL158172.1, AP001501.1, AP001499.1
SEQ ID NO: 492
ZH1276/T3

NM_004127.2, U20285.2, X87885.1, AE003519.1, AF129080.1, AL133469.1, X86780.1, AC002059.3, AC000026.3,
NM_001127.1, L13939.1, U36256.1, AC016795.4, U48889.1, AC020626.6, AE003539.1, AE003486.1, AE003463.1,
U66722.1, AF029395.1, AJ242980.1, AJ243806.1, U 1124.1, AL046753.1, AA315980.1, AA776140.1, AA308668.1,
AI195918.1, AW379968.1, AA794667.1, AW379969.1, AW401492.1, Z44978.1, AA627685.1, R33383.1, R22366.1,
AW250694.1, AA337940.1, Z45804.1, W65922.1, AW379955.1, H 12155.1, AA492726.1, AF031560.1, AW491649.1,
AA026010.1, AW414640.1, AW250541.1, AA972517.1, R75578.1, AW660352.1, AA870416.1, AA065408.1,
AA170086.1, AA368286.1, AW423128.1, AW748739.1, AA051022.1, M958622.1, AA688596.1, AW674959.1,
AW175196.1, AA330082.1, R73336.1, AW806517.1, W69617.1, C83545.1, C82689.1, AA979613.1, H32851.1,
AI496702.1, AA210626.1, AA109188.1, AA517695.1, W17566.1, AW248164.1, AI194303.1, AW462925.1, AI617037.1,
AL258459.1, AW584802.1, AW584801.1, AI073824.1, AA166156.1, AW459926.1, AA566237.1, D26329.1, AW680375.1,
AW527841.1, AI855245.1, AI855218.1, AI855212.1, AI734700.1, AI404003.1, AA524064.1, AA251639.1, W59814.1,
W29472.1, AC015708.3, AL353692.3, AC015160.1, AC020879.2, AC016919.5, AC026832.2, AC020611.4, AC026114.6,
AL356245.1, AC055706.3, AC036180.2, AC069027.3, AC026689.3, AC011558.4, AC026953.2, AC037432.1,
AC007643.2, AC021558.3, AC010884.4, AC020509.1, AC017158.1, AC017776.1, AF207954.1, AC004630.2,
AL353719.3, AL356100.1, AL161897.3, AL162311.1, AL157757.1, AP001095.2
SEQ ID NO: 493
ZH176/T3

NM_004127.2, U20285.2, X87885.1, AE003519.1, AF129080.1, AL133469.1, AC002059.3, AC000026.3, NM_001127.1,
L13939.1, U36256.1, X86780.1, AE003486.1, AC016795.4, U48889.1, AC020626.6, AE003571.1, AF162681.1,
AC005342.1, U66722.1, AL110479.1, AJ242980.1, U40726.1, U40725.1, U40724.1, U40723.1, U40721.1, S71660.1,
AJ243806.1, Z92530.1, Y09870.1, AA315980.1, AA308668.1, AL046753.1, AA776140.1, AA794667.1, R22366.1,
AI195918.1, AW250541.1, R33383.1, AA972517.1, AA627685.1, AW414640.1, AW379968.1, AW748739.1,
AA337940.1, AW379969.1, AW401492.1, AA492726.1, Z44978.1, R73336.1, AW250694.1, W65922.1, AA026010.1,
AF031560.1, Z45804.1, AW491649.1, AA109188.1, AW379955.1, H12155.1, R75578.1, AA051022.1, AA302223.1,
AW660352.1, AA065408.1, AA368286.1, W17566.1, AA870416.1, AW423128.1, AA170086.1, AA865730.1,
AA445357.1, AA279618.1, AI958622.1, AW175196.1, W09671.1, AA979613.1, AW147429.1, AI035492.1, AA688596.1,
AA062100.1, AI496702.1, AW213099.1, AA210626.1, W89993.1, C83545.1, C82689.1, AA517695.1, AW674959.1,
AI194303.1, AI693878.1, AI617037.1, AL258459.1, AA330082.1, M525953.1, AC015708.3, AL353692.3, AC015160.1,
AC020611.4, AC026114.6, AC020879.2, ACXII6919.5, AC026832.2, AC063964.1, AC024460.2, AC025553.2,
AC024258.1, AC017158.1, AL356245.1, AC016932.4, AC055706.3, AC069027.3, AC068583.1, AC026953.2,
AC053468.1, AC023414.2, AC037432.1, AC007643.2, AC020690.4, AC019163.3, AC010884.4, AC014559.1,
AL353719.3, AL356100.1, AL161897.3, AL162311.1, AL157757.1, Z98855.1, AP001372.1, AP001095.2

TABLE 1-continued

Sequence homologies (GenBank Accession Numbers)

SEQ ID NO: 494
ZH176/T7
U20285.2, NM_004127.2, X87885.1, J055171 NM_007438.1, AL133445.2, X03797.1, Y00516.1, AC010510.6,
AC007314.3, AL136059.2, AL031780.1, Z16710.1, AF144093.1, AC006449.19, AL032626.1, AL137716.1, AL031721.1,
Z98257.1, AL078630.1, M36535.1, M17843.1, D00451.1, D00185.1, D00361.1, AI056387.1, AI567797.1, AI139695.1,
AW247126.1, AI669053.1, AI685726.1, AL272746.1, AL202810.1, AI131335.1, AW732050.1, AI743281.1, AW167515.1,
AI458542.1, AI859762.1, AI377236.1, AW246831.1, AI492268.1, AI479985.1, AI952561.1, AA595162.1, AA573934.1,
AL299166.1, AA662524.1, AI951858.1, AA994505.1, AA988396.1, AA604679.1, AA988395.1, AA716051.1,
AA580208.1, AA994504.1, AA583446.1, AI799551.1, AI564292.1, AA521025.1, AA569807.1, AI928074.1, AI513703.1,
AA969251.1, AA931856.1, AA657992.1, AL272794.1, AI796670.1, AI091930.1, AA749404.1, AI810703.1, F24930.1,
AA847278.1, AW188344.1, AI825867.1, F24931.1, AI521316.1, AI471309.1, AA708597.1, AI961737.1, AA757891.1,
AA732155.1, AA807224.1, AL240890.1, AA974663.1, AI885726.1, AI638230.1, AI871463.1, AA766100.1, AI090239.1,
AW249881.1, AI808546.1, AA434157.1, AL285895.1, AW474426.1, AW189219.1, AW674940.1, AW300960.1,
AI868353.1, AI470209.1, AA923622.1, AW166880.1, F25087.1, AA913078.1, AA481945.1, AW513345.1, AW592528.1,
AI818261.1, AI870480.1, AI354982.1, AW591711.1, AI934744.1, AI458656.1, AW073126.1, AI925790.1, AI360724.1,
AW304052.1, AA993663.1, AW651615.1, M864783.1, AA862926.1, AW316592.1, AL270639.1, Z41443.1, AA482068.1

SEQ ID NO: 495
ZH183/T3

NM_004127.2, U20285.2, X87885.1, AE003519.1, AF129080.1, AL133469.1, AC002059.3, AC000026.3, NM_001127.1,
L13939.1, U36256.1, X86780.1, AE003486.1, AC016795.4, U48889.1, AC020626.6, AE003571.1, AE003532.1,
AF208486.1, NM_000377.1, AF196970.1, AF162681.1, AF158549.2, AC005543.2, AC005342.1, U66722.1, U19927.1,
AC005194.1, AF067616.1, AL110479.1, AJ242980.1, U40726.1, U40725.1, U40724.1, U40723.1, U40721.1, S71660.1,
AJ243806.1, Z925 30.1, U12707.1, Y09870.1, AA315980.1, AA308668.1, AL046753.1, AA776140.1, AA794667.1,
R22366.1, AI195918.1, R33383.1, AW250541.1, AA627685.1, AW379968.1, AA972517.1, AA337940.1, AW414640.1,
AW379969.1, AW401492.1, Z44978.1, AW748739.1, AA492726.1, AW250694.1, R73336.1, W65922.1, AA026010.1,
AF031560.1, Z45804.1, AW491649.1, AW379955.1, H12155.1, R75578.1, AA109188.1, AA051022.1, AW660352.1,
AA065408.1, AA368286.1, AA870416.1, AW423128.1, W17566.1, AA170086.1, AA302223.1, M958622.1, AA445357.1,
AW175196.1, AA865730.1, AA279618.1, W09671.1, AA979613.1, AA688596.1, AI496702.1, AA210626.1, AI035492.1,
AA062100.1, C83545.1, C82689.1, AW147429.1, AA517695.1, AW213099.1, W89993.1, AW674959.1, AI194303.1,
AL258459.1, AI617037.1, AA330082.1, AW584802.1, AW586915.1, AI073824.1, AA390628.1, AW459926.1,
AI404003.1, AA566237.1, W69617.1, D26329.1, AW680375.1, AW401800.1, AW261771.1, AV371344.1, AV370592.1,
AI855245.1, AI855218.1, AI855212.1, AI734700.1, AU057766.1, AI558068.1, AI515797.1, AI455890.1, AA817166.1,
C73394.1, AA539163.1, AA524064.1, AA141792.1, W59814.1, W29472.1, U37979.1, H04932.1, D48939.1, D48247.1,
AC015708.3, AL353692.3, AC015160.1, AC020611.4, AC026114.6, AC020879.2, AC016919.5, AC026832.2,
AC025553.2, AC021978.4, AC011241.3, AC017158.1, AL356245.1, AC055706.3, AC015970.4, AC069027.3,
AC011353.3, AC026953.2, AC053468.1, AC037432.1, AC019005.4, AC011944.3, AC007643.2, AC010060.7,
AC010884.4, AC019802.1, AC014559.1, AC006741.2, AL353719.3, AL356100.1, AL139191.3, AL161897.3,
AL162311.1, AL157757.1, Z98855.1, AP001095.2

SEQ ID NO: 496
Liprins, Tyrosine Phosphatase-Interacting Protein

NM_003625.1, AF034799.1, NM_003626.1, U22816.1, U22815.1, L16840.1, AB014554.1, AC006695.1, AF053008.1,
Z68218.1, L06326.1, AC008526.5, AC004805.1, Z50794.1, Z49066.1, U49510.1, AC025808.8, AC010494.4, AC008940.3,
AC024609.2, AF224669.1, AC008069.3, AF170122.1, AP180335.1, AF079271.1, AF104919.1, AC005855.1, AC003684.1,
AC004102.1, AC003997.1, AL049555.6, AL132776.11, AL161492.2, AL133012.1, AL023534.1, Z75747.1, AL031313.1,
Z83827.1, AL022152.1, AB009048.1, AW046469.1, AL040578.2, AL040526.2, AA405311.1, AW163189.1, AV216286.1,
AV098238.1, AI586144.1, R18931.1, AW739485.1, AW651017.1, AW648174.1, AW513939.1, AW355770.1,
AW279529.1, AW276572.1, AV383282.1, AI972830.1, AI851698.1, AI851697.1, M831899.1, AI539950.1, AL268862.1,
AL205406.1, AI110543.1, AU012446.1, AI066756.1, AI027679.1, AA967290.1, AA877239.1, AA776237.1, AA689301.1,
AA630746.1, AA405312.1, AA294505.1, C16133.1, N65637.1, D79793.1, D70186.1, H95071.1, H88097.1, R98374.1,
R17683.1, AC011316.8, AC069228.1, AC025413.2, AP001787.1, AP000487.2, AC008687.3, AC022764.3, AC022788.2,
AC006740.2, AL139045.7, AC020649.4, AC069216.1, AC012604.3, AC017043.3, AC021122.3, AC020715.2

SEQ ID NO: 497
ZH1213/T3
NM_003625.1, AF034799.1, NM_003626.1, U22816.1, U22815.1, AC006695.1, AF053008.1, L06326.1, Z49066.1,
L05915.1, M64268.1, X58390.1, AC025808.8, AC010494.4, AC024609.2, AF224.669.1, AC007450.1, AF079271.1,
AF104919.1, AF078802.1, AC003684.1, AL132776.11, AL161492.2, AL133012.1, U81831.1, Z75747.1, Z83827.1,
AL022152.1, AJ248283.1, AB009048.1, AW046469.1, AW163189.1, AV216286.1, AV098238.1, AW651017.1,
AW648174.1, AV383282.1, R98374.1, AC011316.8, AP001787.1, AP000487.2, AC022764.3, AC006740.2, AL139045.7,
AC017043.3, AC021122.3, AC020715.2, AC005180.9, AC024898.7, AC024238.2, AC010307.4, AC011369.3,
AC068460.1, AC024636.3, AC034191.2, AC018797.3, AC027224.2, AC027631.2, AC026377.2, AC019252.3,
AC016363.3, AC026073.2, AC025527.2, AC021114.3, AC018954.4, AC021718.3, AC024629.1, AC016448.3,
AC023483.2, AF153342.2, AC005961.1, AL355143.4, ALL21876.27, AL138921.6, AL138741.3, AL353599.5,
AL158197.6, AL022167.1, AP002018.1, AP001006.1

SEQ ID NO: 498
ZH1213/T7

AK000348.1, NC_001807.2, J01415.1, X93334.1, V00710.1, V00662.1, X62996.1, D38112.1, D50525.1, AB004064.1,
NC_001643.1, D38113.1, X93335.1, NC_001644.1, D38116.1, X99189.1, NC_001645.1, D38114.1, X93347.1,
NC_002083.1, X97707.1, NC_001646.1, D38115.1, NC_002082.1, X99256.1, AF058292.1, AF176066.1, AF004338.1,
7.54552.1, Z54553.1, 7.60381.1, U63507.1, U63506.1, U63505.1, U63486.1, NC_001992.1, Y18001.1, Z62861.1,
7.62860.1, U63488.1, U63487.1, Z62093.1, 7.57443.1, M86498.1, NC_001567.1, J01394.1, U39004.1, V00654.1,
AB033608.1, Z65548.1, NC_001700.1, U20753.1, S75063.1, M864951 NC_0016011 NC_001321.1, X72204.1,
X61145.1, M86501.1, NC_001941.1, AF010406.1, M86499.1, M35875.1, NC_001779.1, X97336.1, AJ010814.1,
M55539.1, AJ010816.1, AJ010815.1, NC_001808.1, M35877.1, Y07726.1, AF203744.1, M86497.1, AF203774.1,
AF203727.1, U97337.2, NC_001913.1, AF203741.1, AJ001588.1, M55541.1 NC_002391.1, AF203743.1, YI9192.1,

TABLE 1-continued

Sequence homologies (GenBank Accession Numbers)

AF203742.1, AF069538.1, M86493.1, U97336.2, AF069537.1, AB032843.1, AB032842.1, AF179288.1, M55540.1,
U97339.2, U97343.1, AP179290.1, AF203726.1, AJ010812.1, AF069533.1, AJ245896.1, AW603665.1, AI061586.1,
AL047741.1, AI133246.1, AW601774.1, AI061658.1, AI110678.1, AW849003.1, AW848377.1, AW848797.1,
AW868260.1, AW848724.1, AW848653.1, AW848366.1, AI499067.1, AW848373.1, AW848226.1, AW848180.1,
AW607912.1, AW837520.1, AW835394.1, AW848445.1, AW848175.1, AW867448.1, AW848368.1, AI114451.1,
AW848376.1, AW835382.1, AW161643.1, AW837509.1, AW578366.1, AA219735.1, AW867405.1, AW578361.1,
AL037474.2, AW842623.1, AW157026.1, AI983822.1, AA196173.1, AA099002.1, AA469432.1, AW867402.1,
AW578374.1, AA088843.1, AI525751.1, AW848920.1, AW607758.1, AW058235.1, AW837514.1, AI057519.1,
AA814643.1, AA220989.1, AI961435.1, AI525710.1, AA100034.1, AW601494.1, AW842070.1, AI955201.1, AI889478.1,
AW168799.1, AW864632.1, AI133661.1, AA574454.1, AA083209.1, AA776938.1, AW835463.1, AI921008.1,
AI192705.1,7.98526.1, AA179899.1, M683759.1, AW578372.1, AI983554.1, AI983243.1, AI683947.1, AI525757.1,
AA467764.1, AW801146.1, AA225870.1, AW577755.1, AI557286.1, AA223928.1, AW604355.1, AI954959.1,
AW602132.1, AW074139.1, AI687413.1, AW839594.1, M922568.1, AA668465.1, AW607161.1, AI961417.1,
AI858348.1, AI814152.1, AI444594.1, AW848995.1, AA468311.1, AI829389.1, AA747096.1, AA469385.1, AC068619.1,
AC021914.3, AL158819.2, AL135939.9, AC015935.4, AC022317.4, AC067925.1, AC021473.3, AL161450.4,
AC025380.2, AC012365.3, AC018441.3, AC027019.2, AC021451.2, AC021835.3, AC024498.2, AC025283.1,
AL356135.2, AL353646.1, AC023928.3, AF182108.1, AL139000.2, AC025337.1, AC024248.3, AC011954.5,
AC011025.4, AP001947.1, AL121927.18, AC007400.2, AC025936.2, AC058808.1, AC()51663.4, AC025731.7,
AL354955.1, AC024033.2, AC027175.2, AC010270.4, AC068621.1, AC009796.3, AC027008.2, AL158207.3,
AC011821.4, AC013297.4, AC016052.2, AC026968.2, AL353147.3, AC018463.4, AC027413.2, AC026993.2,
AC024953.3, AC019304.3, AC026519.1, AC022206.2, AL109955.13, AP001026.1, AP000919.2, AC019074.3,
AC053 543.3, AC026743.3, AC010496.4, AC027496.2, AC005140.6, AF202964.1, AC005139.3, AL158067.5, AL355432.1
SEQ ID NO: 499
H1292/T3

, NM_003625.1, AF034799.1, NM_003626.1, U22816.1, U22815.1, L16840.1, AB014554.1, AC006695.1, AF053008.1,
Z68218.1, L06326.1, AC008526.5, AC004805.1, 7.50794.1, U49510.1, AC025808.8, AC010494.4, AC008940.3,
AC024609.2, AF224669.1, AC008069.3, AF170122.1, AF180335.1, AF079271.1, AF104919.1, AC005855.1, AC003684.1,
AC004102.1, AC003997.1, AL161492.2, AL023534.1, AL049555.6, AL132776.11, AL031313.1, 7.83827.1, AB009048.1,
AW046469.1, AL040578.2, AL040560.2, AA405311.1, AW163189.1, AW906518.1, AW906447.1, AV216286.1,
AV098238.1, AI586144.1, R18931.1, AW739485.1, AW513939.1, AW355770.1, AW279529.1, AW276572.1,
AV383282.1, AI972830.1, AI851698.1, AI851697.1, AI831899.1, AI539950.1, AL268862.1, AL205406.1, AI110543.1,
AU012446.1, AI066756.1, AI027679.1, AA967290.1, AA877239.1, AA776237.1, AA689301.1, AA630746.1,
AA405312.1, AA294505.1, C16133.1, N65637.1, D79793.1, D70186.1, H95071.1, H88097.1,R17683.1, AC011316.8,
AC069228.1, AC025413.2, AP001787.1, AP000487.2, AC008687.3, AC022764.3, AC022788.2, AC006740.2,
AL139045.7, AC069216.2, AC069259.1, AC020649.4, AC012604.3, AC017043.3, AC021122.3, AC020715.2,
AC026250.4, AC024898.9, AC008180.9, AC053478.2, AC024238.2, AC010307.4, AC068460.1, AC024636.3,
AC034191.2, AC018797.3, AC009612.3, AC025988.2, AC021878.2, AC018954.4, AC021010.3, AC024655.1,
AC022911.2, AC023483.2, AC016043.3, AC011290.2, AC005961.1, AL355143.4, AL353599.5, AL158197.6,
AP002018.1, AP001865.1,
SEQ ID NO: 500
ZH1292/T7

AL109985.2, AL031662.25, AL163282.2, AL031848.11, AC006323.3, AC008033.8, AC009230.3, AC011310.3,
AC010072.5, AC2000353.27, AF217796.1, AC2004130.1, AC004990.1, AC008062.2, AC004987.2, AC006213.1,
AF001549.1, AC004638.1, AF042090.1, AL157756.2, AF003627.1, AL133399.1, AL031224.1, AI031542.1,
AC000952.16, AC004019.20, AC004417.1, AC010I70.3, AC004490.5, AC025588.1, AC000159.6,
AC004875.1, AC006006.2, AC002492.1, AC005701.1, AC005523.1, AF064863.1, U63721.1, AC002402.1, AL021808.1,
AL163262.2, AL137039.1, AL133387.8, AL035697.19, AL008582.11, AP001717.1, AP001410.1, AP000I91.1,
AP000159.1, AP000047.1, D87009.1, AP000556.2, AP000115.1, AC004590.2, AC002310.1, AC020629.6, AL163215.2,
Z93023.1, AP001670.1, AC008039.1, AC016025.12, AC0107f1.2, AC009079.4, AC006111.2, AC006012.2, AC005019.1,
AC007387.3, AC005057.2, AC005660.3, AF039907.1, AC006544.19, AC005901.1, AC005962.1,
AC005755.1, AL136000.2, AL163223.2, AL135744.2, AL049776.3, AL021937.1, AL031178.1, AL035249.6, U62293.1,
AP001678.1, AP001256.2, AC005072.2, AF067752.1, AL023575.1, AC009303.2, AC006511.5, AL163230.2, AP001685.1,
AC000004.1, AC007030.3, AC004821.2, AC004234.1, AJ239318.3, AC008109.6, AC005565.1, AA553710.1, R72458.1,
AI471543.1, P36273.1, AL284640.1, AI610159.1, AI471481.1, AI334443.1, AI053672.1, AA542991.1, AW673241.1,
AA825357.1, AA810370.1, AA350859.1, N25296.1, AW769399.1, AW511743.1, AW419262.1, AW276827.1,
AW193432.1, AW193265.1, AI963720.1, AL046409.1, AI688846.1, AI613280.1, AI431303.1, AI350211.1, AI341664.1,
AI061334.1, AL046457.1, AL281697.1, AW338086.1, AI358343.1, T07451.1, AW731867.1, AW504326.1, AW166815.1,
AW162049.1, AL120483.1, AW029038.1, M962050.1, AI929531.1, AI904894.1, AI890923.1, AF150222.1, AI375710.1,
AL281881.1, AI133164.1, AA649642.1, AA535661.1, AA134367.1, AF150152.1, AA771811.1, AA491814.1,
AW276817.1, AI339850.1, AL251002.1, AA191620.1, AW833903.1, AW576391.1, AW517377.1, AW303876.1,
AI887483.1, AL287651.1, AA664015.1, AA599920.1, AA533725.1, AA525876.1, W79504.1, AW600804.1, AL038785.1,
AI679782.1, AI567674.1, AI168185.1, AI133636.1, AA747472.1, AA630030.1, AA084070.1, N55273.1, AW339568.1,
AW303196.1, AW301350.1, AW274349.1, AA581903.1, N71930.1, AW833898.1, AI358571.1, AW265385.1,
AL119691.1, AI830390.1, AL298710.1, AA970213.1, AA280632.1, AW104748.1, AL251436.1, AA515224.1, AA364429.1,
AI160117.1, AI537955.1, AW474299.1, AL157387.1, AC022931.3, AC008443.4, AC021879.3, AC021401.4, AL161615.2,
AC005973.4, AC026331.3, AC025175.2, AC009122.5, AC023359.6, AC025699.4, AC035141.2, AC034222.2,
AC026442.2, AC020893.4, AC011670.4, AC018637.1, AC012042.9, AC009228.3, AC044801.1, AC025564.3,
AC025829.2, AC021160.3, AC016891.3, AC021957.3, AC021777.3, AC027283.1, AC011768.4, AC025054.2,
AC024437.2, AC013648.3, AC013768.4, AC011844.3, AC022989.2, AC022845.2, AC023516.1, AC017078.3,
AC013733.3, AC012410.2, AC013262.3, AC010165.2, AL049537.36, AU53715.3, AL138703.2, AU 36223.3,
AL157372.6, AL355521.1, AL160275.2, AP000631.3, AC019222.3, AL354723.1, AC055879.2, AC008622.4,
AC016555.4, AC034119.1, AC022626.3, AL136221.8, AC064821.2, AC046165.2, AC053540.2, AC0J 1511.4,
AC009040.4, AC027709.2, AC027096.2, AC008531.2, AC011430.4, AC025935.2, AC012141.2, AC021037.4,
AC019327.4, AC018573.2, AC015758.3, AC021661.1, AC007163.2, AL109965.22, AL354935.3, AC010095.3,
AC011490.4, AC021634.4, AL355515.2, AL158081.1, AC009245.8, AC068364.1, AC005047.2, AC023133.2,

TABLE 1-continued

Sequence homologies (GenBank Accession Numbers)

AC026141.2, AC012662.5, AC009417.2, AC011840.3, AC0fl985.2, AC007799.4, AC016978.2, AC005910.4,
AF129075.1, AP000931.2, AC010649.5, AC021805.3, AC009070.5, AL121752.7
SEQ ID NO: 501
ZH1303/T3

NM_003625.1, AF034799.1, NM_003626.1, U22816.1, U22815.1, L16840.1, AC006695.1, AF053008.1, L06326.1,
Z49066.1, AC025808.8, AC010494.4, AC007267.4, AC012262.14, AC024609.2, AF224669.1, AC005013.1, AF079271.1,
AF104919.1, AC005194.1, AC003684.1, Z72001.1, AL132776.11, AJ276674.1, AL161492.2, Z75747.1, Z70049.1,
AL034428.1, Z83827.1, AL022152.1, AL033388.1, AB009048.1, AW046469.1, AW163189.1, AV216286.1, AV098238.1,
AW534545.1, AV383282.1, AA819367.1, AA945965.1, W67890.1, AC011316.8, AC069228.1, AP001787.1, AP000487.2,
AC022764.3, AC046202.2, AC022788.2, AC006740.2, AL139045.7, AP001989.1, AP001912.1, AC017043.3,
AC021122.3, AC022911.2, AC020715.2, AC068908.2, AC008180.9, AC024898.7, AC023358.5, AC068909.3,
AC024238.2, AC010290.6, AC011369.3, AC027784.2, AC068460.1, AC026918.2, AC024636.3, AC068338.1,
AC034191.2, AC018797.3, AC027224.2, AC019252.3, AC034183.1, AC026073.2, AC025527.2, AC021115.3,
AC018954.4, AC018911.4, AC023120.3, AC011678.4, AC024629.1, AC018927.3, AC023483.2, AF153342.2,
AC005961.1, AL355143.4, AL136523.3, ALL21876.27, AL353599.5, AL135938.7, AL162418.2, AL155197.6,
AL139085.1, AL022167.1, AP002018.1, AP001006.1
SEQ ID NO: 502
ZH1303/T7

NM_003625.1, AF034799.1, NM_003626.1, U22816.1, U22815.1, AE003614.1, AC003052.1, AB014554.1, AF034801.1,
AF034800.1, AE003420.1, AL049595.5, AL031128.1, X95296.1, NM_014786.1, AC007187.4, AE003804.1, AC002075.1,
AC008171.2, AC007682.2, AC007967.3, AF147264.1, AC007015.1, AC005670.1, AC002326.1, AL096678.8,
AL161506.2, Y12377.1, AL121774.3, AL138657.1, AL034546.5, AL109618.1, AL022165.1, AL009031.1, AB020484.1,
AB002335.1, AA325780.1, AV280945.1, AA393329.1, AW675288.1, AW295112.1, AW440279.1, AL266228.1,
AL263426.1, AA907742.1, AA034766.1, AW315478.1, AA545569.1, AW200169.1, R85656.1, AI354381.1, N99720.1,
AL119228.1, AI124575.1, H83858.1, AW218738.1, AW218737.1, AW033855.1, AI655831.1, AW642591.1, AW321115.1,
AW234483.1, AI142271.1, AU008944.1, AA755708.1, AC011316.8, AP000487.2, AC025413.2, AC017785.1,
ACJ008687.3, AC016968.11, AC018355.10, AC013543.4, AC034187.1, AC023866.2, AC025210.2, AC016968.10,
AF216798.1, AC068529.1, AC022327.6, AC021514.3, AC027703.1, AC021556.3, AC013263.3, AC017682.1,
AL355980.2, AL162491.3, AL158038.2, AC063958.7, AC040991.2, AC055744.2, AC023883.4, AC025732.3,
AC053503.3, AC026270.2, AC068719.1, AC068658.1, AC008402.4, AC068152.1, AC011645.3, AC025640.3,
AC009504.3, AC010086.3, AC021107.2, AC009952.3, AC026009.2, AC019001.3, AC008466.2, AC022545.3,
AC020879.2, AC007520.6, AC015875.1, AC021413.1, AC014270.1, AC007835.5, AC011624.4, AC013501.1,
AC010I41.1, AL122019.21, AL355333.3, AL157784.3, AL353147.3, AL157397.2, AL158813.3, AL353722.2,
AL139820.2, AL138883.4, AL138933.1, AP002010.1, AP001324.1, AP000915.2, AP000562.2, AP001104.1
SEQ ID NO: 503
ZH140/T3

NM_003625.1, AF034799.1, NM_003626.1, U22816.1, U22815.1, L16840.1, AC006695.1, AF053008.1, L06326.1,
Z49066.1, AC025808.8, AC010494.4, AC024609.2, AF224669.1, AF079271.1, AC005800.1, AF104919.1, AC003684.1,
AL132776.11, AL161492.2, AL133012.1, Z75747.1, Z83827.1, AL022152.1, AL008629.9, AL022575.1, AB009048.1,
AW046469.1, AW163189.1, AV216286.1, AV098238.1, AW651017.1, AW648174.1, AV383282.1, AA132209.1,
N65637.1, R98374.1, AC011316.8, AC069228.1, AP001787.1, AP000487.2, AC022764.3, AC022788.2, AC006740.2,
AL139045.7, AC017043.3, AC021122.3, AC020715.2
SEQ ID NO: 504
ZH023/T3

AP000346.1, AP000345.1, AL136419.2, AL023753.1, AL035587.5, AC005103.27, AC007326.28, AF164615.1,
AF164614.1, AF164609.1, X72791.1, Y17834.1, Y10392.1, AC008996.5, AF164610.1, Y17832.2, AF074086.1,
AF164611.1, Y17833.1, Y18890.1, AC016577.4, AF164613.1, AL121985.13, Y10390.1, Y08032.1, AF164612.1,
M14123.1, AL031668.20, AC004034.1, AF240627.1, AL163218.2, AL109763.2, AC004979.1, AF018155.1, AF018154.1,
AF018153.1, AC003072.1, AC006998.2, AC004889.1, AB020866.1, M77994.1, M824517.1, AA218808.1, AL267359.1,
AW527945.1, AW632310.1, AW632272.1, AI959137.1, AA335344.1, AC009761.4, AC022412.3, AC012068.3,
AC022770.4, AC034203.3, AF235103.1, AC024690.2, AC022703.1, AL158815.4, AC006078.1, AP000776.1,
AC024108.5, AC044819.2, AC055116.2, AC023074.2, AC011647.5, AC026957.2, AC004127.1, AC008726.4,
AC008535.3, AP000869.1, AP000714.1, AC025420.4, AL355987.3, AC015686.2, AP000831.1, AC021655.8,
ALL21932.15, AC068728.3, AC018829.3, AC018809.3, AC026685.1, AC022007.2, AC024612.1, AC021996.1,
AL353807.3, AC067827.1, AC060818.2, AC055887.1, AC021973.2, AC012309.6, AC010632.5, AC027082.2,
AC025757.2, AC012282.3, AC068099.1, AC069047.1, AC012043.5, AL356095.1, AC041049.2, AC008750.6,
AC024725.2, AC024710.2, AC009505.2, AP001161.1, AC007322.3, AC024236.3, AC011060.5, AL160407.4,
AC024884.6, AC010640.5, AC008517.4, AC027524.2, AC025659.2, AC062019.1, AC034166.2, AF238379.1,
AC021878.2, AC026854.1, AC022182.3, AC0L2407.2, AP001583.1, AP001865.1, AC069151.1, AC068541.2,
AC025187.3, AC068030.1, AC009504.3, AC010086.3, AC044825.1, AC027051.1, AC022631.3, AL031011.20,
AP002013.1, Z95393.1
SEQ ID NO: 505
ZH023/T7

AP000346.1, AP000345.1, AL035587.5, AB016195.1, AL031668.20, U64453.1, M30520.1, AC016577.4, AC007326.28,
AF164611.1, AF164610.1, AF164609.1, M14123.1, AF164612.1, AF074086.1, AF164614.1, Y17832.2, Y17834.1,
Y17833.1, AF164613.1, AL121985.13, Y18890.1, AC008996.5, Y10391.1, AF240627.1, AL109763.2, AL163218.2,
M11348.1, AD000090.1, AC004220.1, AF164615.1, AL023753.1, AC012005.3, AC006328.4, X82272.1, AF080231.1,
AF080230.1, X92887.1, AF080229.1, AF080234.1, AC003100.1, AF080232.1, AF080233.1, AL022154.1, AC006383.2,
AC000385.1, AL109963.4, AB020866.1, AC004924.2, Z99129.1, AC006998.2, AF228552.1, U91321.1, AF033807.1,
AC005858.1, x01811.1, M15122.1, K01707.1, K01788.1, AC006346.1, AC002113.1, AF020092.1, U27242.1, U36927.3,
AE002133.1, AF016685.1, AL035593.11, X78560.1, L27838.1, AF130358.2, AL161639.4, AL160008.1, AC025638.3,
AL158815.4, AL356375.1, AF235103.1, AL136108.3, AC015623.3, AC006078.1, AC004127.1, AC024690.2,

TABLE 1-continued

Sequence homologies (GenBank Accession Numbers)

AC012068.3, AC044819.2, AC009761.4, AC034203.3, AC008726.4, AC008535.3, AC015686.2, AC015525.3,
AP000869.1, AC053497.2, ALL21932.15, AP000714.1, AP001636.1, AP000576.2, AC068728.3, AL159984.3,
AL353807.3, AP000776.1, AC022770.4, AC010508.5, AC025420.4, AC024108.5, AC027082.2, AP000831.1,
AL355987.3, AC023586.2, AC067789.1, AC008813.4, AC012309.6, AC068020.1, AL356356.1, AC010467.6,
AL031963.25, AC026299.2, AC010632.5, AC026957.2, AC055116.2, AC023074.2, AC011467.5, AC027605.4,
AC068099.1, AC026685.1, AC022007.2, AC018829.3, AC018809.3, AC024612.1, AL137789.2, AL137022.7,
AC068974.1, AC068369.1, AC022412.3, AC021996.1, AP000941.2, AC018865.1, AC026921.2, AP001958.1,
AC024029.3, AC019121.2, AC025059.2, AF231129.1, AF228730.1, AC016095.1, AC008155.6, AL162734.3,
AC021112.3, AC010332.6, AC011313.5, AC034166.2, AC021135.3, AC026854.1, AL160407.4, AC034259.2,
AC048384.2, AC010989.3, AL121954.4, AC021560.3, AC022482.3, AC022631.3, AL162739.4, AC0I0636.5,
AC008976.7, AC008554.6, AC027417.1, AC024710.2, AC022674.2, AC015688.3, AI080480.1, AI651023.1, AI867418.1,
AW003247.1, AI631703.1, AA502500.1, AI352545.1, AL206199.1, AI671282.1, M652535.1, AW451866.1, AA471088.1,
AI818326.1, AA206342.1, AA206331.1, AA126128.1, AA206100.1, AW818140.1, AA204834.1, AW665466.1,
AI480345.1, AW021661.1, AA207155.1, AA206214.1, AI493192.1, AW818171.1, AW137742.1, AI478370.1,
AA528309.1, AA248638.1, AW014214.1, AI818145.1, AI634842.1, M360447.1, R80905.1, AW013827.1, AW182936.1,
AI632006.1, AI362712.1, AA206294.1, R79237.1, AA995742.1, AL214968.1, AF147777.1, AF147766.1, AI326122.1,
AI025177.1, AA175218.1, AV420643.1, AV412674.1, AW593524.1, AW414284.1, AW414173.1, AW229810.1,
AW215773.1, AW211857.1, AI869224.1, AI386228.1, AI385888.1, AI379846.1, AL275423.1, AA212523.1, AA123410.1,
R82513.1, R67081.1, Z19676.1
SEQ ID NO: 506
ZH042/T3

AP000346.1, AP000345.1, AL035587.5, AL136419.2, AL023753.1, AC004034.1, AL031668.20, AC008996.5,
AF164610.1, Y17833.1, AF164615.1, AF164614.1, Y17834.1, AC016577.4, AC008103.27, AC007326.28, AF164613.1,
AF164612.1, AF164611.1, AF164609.1, X72791.1, M14123.1, Y10392.1, Y10390.1, Y08032.1, Y17832.2, AF074086.1,
AL121985.13, Y18890.1, AF240627.1, AL163218.2, AL109763.2, AC004979.1, AF018155.1, AF018154.1, AF018153.1,
Z58085.1, AC003072.1, AC006998.2, AC004534.1, AC004889.1, AJ249770.1, AP000007.1, L20047.1, L01950.2,
AC003999.1, U91321.1, AC007393.3, AC008072.3, AC002306.1, AL161544.2, AL034376.10, U86554.1, Z93020.1,
AL031407.3, Z97341.2, AB029388.1, AB016877.1, M77994.1, AA218808.1, AL267359.1, AI824517.1, AW527945.1,
AI883693.1, AW730784.1, AW632310.1, AW632272.1, AI876468.1, AI606839.1, AI465885.1, AA790298.1, AC009761.4,
AL158815.4, AC022412.3, AC012068.3, AC022703.1, AC024690.2, AF235103.1, AC034203.3, AC022770.4,
AP000776.1, AC044819.2, AC026957.2, AL353807.3, AC025420.4, AL355987.3, AC055116.2, AC023074.2,
AC024108.5, AC021655.8, AC008726.4, AC008535.3, AP000869.1, AP000714.1, AC006078.1, AC004127.1,
AC060818.2, AC068728.3, AC055887.1, AC012309.6, AC010632.5, AC011467.5, AL121932.15, AC025757.2,
AC027082.2, AP000831.1, AC021973.2, AC015686.2, AC026685.1, AC022007.2, AC018829.3, AC018809.3,
AC024612.1, AC021996.1, AC012282.3, AC069047.1, AC026196.1, AC027524.2, AC067827.1, AC012043.5,
AL356095.1, AC008750.6, AC024725.2, AC024710.2, AC009505.2, AP001161.1, AC007322.3, AC024236.3,
AC011060.5, AC026781.2, AC010640.5, AC008517.4, AC024658.3, AC021878.2, AC0214163, AL355513.1,
AP001583.1, AP001865.1, AC016967.9, AC021201.3, AC055810.2, AC025448.3, AC008755.5, AC011386.4,
AC040900.2, AC011448.2, AC023888.6, AC016805.3, AC022197.3, AC037197.1, AC034179.2, AC027210.1,
AC027051.1, AC007460.2, AC024443.2, AC022866.2, AC023190.2, AC016967.8, AC011716.2, AC012191.2,
AC012229.2, AC016200.1, AL161941.7, AL117376.27
SEQ ID NO: 507
ZH042/T7

AP000346.1, AP000345.1, AL035587.5, AB016195.1, M30520.1, U64453.1, AL031668.20, AC016577.4, AC007326.28,
AF164611.1, AF164610.1, AF164609.1, M14123.1, AF164612.1, AF074086.1, AF164614.1, Y17832.2, Y17834.1,
Y17833.1, AF164613.1, AL121985.13, Y18890.1, AC008996.5, Y10391.1, AF240627.1, AL109763.2, AL163218.2,
AD000090.1, M11348.1, AC004220.1, AF164615.1, AL023753.1, AC012005.3, AC006328.4, X82272.1, AF080231.1,
AF080230.1, AF080229.1, AF080234.1, AF080232.1, AF080233.1, U47118.1, X92887.1, AC003100.1, AL022154.1,
AC006383.2, AC000385.1, AL109963.4, AB020866.1, AC004924.2, Z99129.1, AC006998.2, AF228552.1, U91321.1,
AF033807.1, X01811.1, M15122.1, K01707.1, K01788.1, AC002113.1, AF020092.1, U27242.1, AF130358.2,
AL163241.2, AJ009632.2, AP001696.1, AI651023.1, M080480.1, AW003247.1, AI867418.1, AI631703.1, AA502500.1,
AI352545.1, A.1206199.1, AI671282.1, AI652535.1, AW451866.1, AI818326.1, AA471088.1, AA206342.1, AA206331.1,
AA206100.1, AA126128.1, AW818140.1, AW665466.1, AA204834.1, AI480345.1, AI493192.1, AW021661.1,
AA206214.1, AA207155.1, AW818171.1, AA204833.1, AW137742.1, M478370.1, AA528309.1, AA248638.1,
AW014214.1, AI818145.1, AI634842.1, AI360447.1, R80905.1, AW496808.1, AW013827.1, AW182936.1, AI632006.1,
AI362712.1, AA206294.1, AA206262.1, AA995742.1, AV172265.1, AL214968.1, AI326122.1, AW414284.1,
AW414173.1, AW211857.1, AL161639.4, AL160008.1, AC025638.3, AL158815.4, AF235103.1, AL356375.1,
AC015623.3, AL136108.3, AC012068.3, AC024690.2, AC006078.1, AC004127.1, AC044819.2, AC009761.4,
AC008726.4, AC008535.3, AC015686.2, AC015525.3, AP000869.1, AC053497.2, AL121932.15, AP000714.1,
AC068728.3, AL159984.3, AC034203.3, AP001636.1, AP000576.2, AC022770.4, AC025420.4, AC010508.5,
AL353807.3, AP000776.1, AC024108.5, AC027082.2, AP000831.1, AC023586.2, AL355987.3, AC008813.4,
AC012309.6, AC067789.1, AC068020.1, AL356356.1, AC010467.6, AC010632.5, AC026957.2, AC026299.2,
AL031963.25, AC055116.2, AC023074.2, AC027605.4, AC011467.5, AC068974.1, AC068099.1, AC026685.1,
AC022007.2, AC018829.3, AC018809.3, AC024612.1, AL137789.2, AL137022.7, AC068369.1, AC022412.3,
AC021996.1, AP000941.2, AC018865.1, AC026921.2, AP001958.1, AC024029.3, AC019121.2, AC025059.2,
AF231129.1, AF228730.1, AC016095.1, AC008155.6, AL162734.3, AC021112.3, AC010332.6, AC034166.2,
AC021135.3, AC026854.1, AL160407.4, AC034259.2, AC048384.2, AL121954.4, AC026615.2, AC021560.3,
AC022482.3, AL162739.4, AC010636.5, AC008976.7, AC008554.6, AC027417.1, AC024710.2, AC022674.2,
AC015688.3
SEQ ID NO: 508
ZH1347/T3

AP000346.1, AP000345.1, AL035587.5, AL023753.1, AL136419.2, AC004979.1, AL020995.13, AC004034.1,
AL031668.20, AC008103.27, AC007326.28, AF164609.1, Y08032.1, AF074086.1, AF164615.1, AF164614.1,
AF164611.1, Y17834.1, Y17833.1, Y17832.2, AC016577.4, AF164610.1, AC008996.5, AF164613.1, X72791.1,

TABLE 1-continued

Sequence homologies (GenBank Accession Numbers)

M14123.1, Y10390.1, Z86090.10, AF164612.1, AL121985.13, Y18890.1, AL109763.2, AF240627.1, AL163218.2,
AC002350.1, AC004976.1, Z58084.1, Z63110.1, AF078838.1, M12855.1, AC007325.51, M12853.1, M12851.1, X72790.1,
X82271.1, AC004164.1, U32496.1, AF018155.1, AF018153.1, AL121934.15, AB020866.1, AC003973.1, AC009958.2,
AF020503.1, AL137080.2, AC009263.6, AC006565.3, AC005625.1, AC003694.1, AF003473.1, AL161566.2,
AL030978.1, AL080276.9, Z36282.1, Z70203.1, Z84483.1, V01555.1, U62645.1, U70852.1, M80517.1, U51994.1,
AB009666.1, AB017328.1, AI623315.1, AA196978.1, AI917742.1, AI632501.1, AI635368.1, AA704457.1, AI052645.1,
AI970327.1, AI052188.1, AW298218.1, AA922960.1, AA002001.1, N80921.1, W02825.1, N41549.1, N39695.1,
N26360.1, N26114.1, H83743.1, W16915.1, W02818.1, H12051.1, AA205546.1, AW863012.1, AV134770.1, AI700982.1,
AF009724.1, AA233105.1, AI558891.1, AI149795.1, AA525739.1, AA403229.1, AA092763.1, W01643.1, N62346.1,
AL355987.3, AC022412.3, AF235103.1, AL158815.4, AL136108.3, AC022770.4, AC068020.1, AC034203.3,
AC024690.2, AC006078.1, AC008813.4, AL121932.15, AC026786.2, AC027524.2, AC004127.1, AC01 0930.4,
AC026338.4, AC026005.2, AC025638.3, AC012309.6, AC009758.2, AC022262.3, AC010632.5, AC026685.1,
AC026196.1, AC022007.2, AC018829.3, AC018809.3, AC024612.1, AC021996.1, AC008785.3, AC009761.4,
AP000776.1, AC055116.2, AC023074.2, AC011467.5, AC026957.2, AC025420.4, AC008726.4, AC008535.3,
AC021973.2, AP000869.1, AP000831.1, AP000714.1, AC044819.2, AC068942.1, AC067827.1, AC027082.2,
AC068728.3, AC015686.2, AC025757.2, AL353807.3, AC012068.3, AC026484.3, AL353789.1, AC012282.3,
AC009771.4, AC023252.2, AC060818.2, AC069047.1, AC021655.8, AP001636.1, AP000576.2, AC009769.3,
AC008379.5, AC024108.5, AC020933.4, AC020919.4, AC012619.5, AL162734.3, AC026854.1, AL121960.1,
AC041049.2, AC018867.2, AC067732.2, AC022734.2, AC027456.2, AC011881.5, AC018807.4, AC022600.1,
AC027382.2, AC024067.3, AC053522.1, AC008272.1
SEQ ID NO: 509
ZH1347/T7

AP000346.1, AP000345.1, AL035587.5, AL136419.2, AL023753.1, AD000090.1, AC004979.1, AF074086.1, AF164615.1,
AF164614.1, AF164611.1, AF164609.1, Y18890.1, Y17834.1, Y17833.1, Y17832.2, Y10392.1, AL121985.13,
AF240627.1, AC008103.27, AC007326.28, AF164612.1, AL163218.2, AL109763.2, AC008996.5, AC016577.4,
AF164613.1, AF164610.1, M14123.1, U91321.1, AC007379.2, AL078590.27, Y08032.1, AC003072.1, AC010329.3,
Y10390.1, AC008173.2, X77925.1, AE003645.1, AE003411.1, AC006167.1, AC003949.1, U92876.1, Z78418.1,
Z70280.1, AJ224356.1, AB007021.1, AP000511.1, AP000815.1, AB028605.1, AB023050.1, AC012005.3, AC006328.4,
AC008567.4, AF241734.1, AE003777.1, AE003765.1, AC012085.4, AC006331.2, AC012477.1, AF020092.1,
AF027336.1, AL161573.2, AL161503.2, AL078469.2, AL050312.8, AL022154.1, X01729.1, AA923278.1, AI341975.1,
AI650511.1, AI961064.1, AA196979.1, AW236545.1, AW139686.1, AI964001.1, AI824860.1, AI634418.1, AA911045.1,
H77777.1, AW835451.1, AW142813.1, AA943262.1, N40303.1, N95674.1, N36327.1, N34083.1, AW385862.1,
AW010495.1, AI009266.1, AW551014.1, AV370696.1, AV364309.1, AV350688.1, AV331599.1, AV311030.1,
AV310095.1, AV277892.1, AV277769.1, AV277196.1, AV275289.1, AV275221.1, AV270694.1, AV267738.1,
AV265513.1, AV258263.1, AV257384.1, AV243092.1, AV215936.1, AI852680.1, AV158672.1, AV172070.1,
AV146175.1, AV137435.1, AI613692.1, AI482010.1, AA623529.1, AA585880.1, AA516681.1, AA393031.1,
AA389342.1, AA056004.1, N59888.1, H81356.1, AC009761.4, AC009769.3, AL158815.4, AC034203.3, AC024690.2,
AC022770.4, AC012068.3, AC022703.1, AL121932.15, AC012309.6, AC025420.4, AC004819.2,
AC010508.5, AC055116.2, AC023586.2, AC023074.2, AP000869.1, AP000831.1, AC027082.2, AC022007.2,
AC018829.3, AC018809.3, AC021996.1, AL355987.3, AC015686.2, AP000714.1, AC025699.4, AC011467.5,
AC008946.4, AC068728.3, AC008535.3, AC068099.1, AC026957.2, AC026685.1, AC024612.1, AC006078.1,
AC004127.1, AL353807.3, AP000776.1, AC023883.4, AC008539.3, AC011541.3, AC068379.1, AC021107.2,
AC010141.1, AC027293.3, AC024108.5, AC022631.3, AC022486.3, AL137789.2, AC008726.4, AC026921.2,
AL121970.10, AL161669.1, AC068322.1, AC027713.2, AC027284.1, AC024059.2, AC009504.3, AC010086.3,
AC024725.2, AC022882.3, AC022586.1, AC009505.2, AC012059.5, AC020891.4, AL031744.7, AC011313.5,
AC023598.10, AC023597.8, AC022993.3, AC012663.3, AC007991.2, AC068369.1, AC026010.2, AC021560.3,
AL137064.2, AC069185.1, AC026775.2, AC013798.4
SEQ ID NO: 510
Acidic 82 kDa NM_014597.1, U15552.1, AL033375.2, AB018117.1, X78035.1, AC061957.3, AE003665.1, AC004541.1, AC004240.1,
AC000047.6, AC006215.1, AC003665.1, AC003658.1, Y12776.1, NM_014154.1, AE003463.1, AE002612.1, AC006825.1,
AC006679.2, AF161541.1, AF204231.1, AC004883.2, AC005534.2, AC007736.3, AC007385.3, AC008124.8,
AC005520.2, AC005968.1, AC003019.1, AC004388.1, AC003687.1, AF039586.1, AL163202.2, AL137686.1,
AL117569.1, AL049749.2, A.T239318.3, Z99281.1, Z68006.1, AL021786.1, AJ245583.1, AP001135.2, AP000604.1,
Z83733.1, AB023152.1, AB020662.1, X68393.1, X71424.1, U04436.1, AW604388.1, AW578439.1, AA772816.1,
AW604383.1, AA171806.1, AA223318.1, AA300576.1, AW577851.1, X85657.1, AW366303.1, AW366304.1,
AW366300.1, AW366302.1, AW784397.1, AW366308.1, AW106818.1, M892034.1, M790951.1, AA104392.1,
AA098311.1, AW323362.1, AI548718.1, AV239176.1, AW401090.1, AW400879.1, AW400878.1,
AW036673.1, AU085757.1, AW511512.1, AW470214.1, AW330749.1, AW316831.1, AW196290.1, AW193248.1,
AW190941.1, AW190240.1, AI928455.1, AI760032.1, AI695865.1, AV005974.1, AI64.0805.1, AI623468.1, AI567745.1,
AI565060.1, AL206916.1, AL204039.1, AI108782.1, AI041845.1, AA953940.1, AA847791.1, AA440362.1, AA620779.1,
AA456818.1, AA257418.1, AA243360.1, W65778.1, W23329.1, H80920.1, AL049796.27, AL160163.3, AC026139.1,
AL159985.5, AC021056.4, AC026674.4, AC009429.3, AC019322.3, AC037466.2, AC058816.2, AC031988.2,
AC026570.2, AC027200.2, AC026610.2, AC027580.1, AC012089.10, AC010799.2, AC021948.3, A0122049.3,
AC017053.5, AC023860.2, AC021682.1, AC017550.1, AC012021.1, AL139257.5, AL355857.1, AL354933.1,
AL158847.2, AL049180.3
SEQ ID NO: 511
ZH12110/T3

NM_014597.1, U15552.1, AL033375.2, AE003665.1, AC006215.1, AC003665.1, NM_014154.1, AF161541.1,
AC005534.2, AC007736.3, AC007385.3, AC005280.2, AC005520.2, AC004464.1, AC005968.1, U17097.1, AF039586.1,
AL163202.2, AJ239318.3, Z68006.1, AL034351.1, AL031007.1, AL022164.1, AL245583.1, AP001135.2, AP000604.1,
X71424.1, AW604388.1, AW578439.1, AA772816.1, AW604383.1, AA171806.1, AA223318.1, AA300576.1,
AW577851.1, AW784397.1, AW106818.1, AI892034.1, AI790951.1, AA104392.1, AA098311.1, AW323362.1,
AW330749.1, AW091879.1, AW091878.1, AI301143.1, AL206916.1, AA257418.1, W23329.1, AL049796.27,

TABLE 1-continued

Sequence homologies (GenBank Accession Numbers)

AL160163.3, AC021874.12, AC021023.4, AC018656.5, AC011312.5, AC022504.9, AC022362.5, AC007944.2,
AC021874.11, AL159985.5, AC021056.4, AC026674.4, AC009429.3, AC031988.2, AC027200.2, AC027580.1,
AC012089.10, AC021948.3, AC022049.3, AC023860.2, AC021682.1, AC017550.1, AC012021.1, AL355857.1,
AL354933.1, AL158847.2, AC069154.1, AC068777.3, AC069224.1, AC068810.1, AC019109.3, AC063969.1,
AC026690.2, AC025770.3, AC022424.3, AC010269.3, AC068159.1, AC068144.1, AC023390.2, AC067978.1,
AC067924.1, AC025640.3, AC015979.3, AC020559.3, AC007034.3, AC009717.4, AC007343.3, AC012336.2,
AC011193.2, AC024739.3, AC016100.4, AC016012.5, AC020583.2, AC011177.3, AC023232.3, AC017085.2,
AC012460.3, AC021510.2, AC015532.1, AC009687.2, AC009878.3, AC016076.1, AC016001.1, AC009638.2, U82207.1,
AL354752.4, AL139797.3, AL352979.1, AL159141.1, AL136332.1
SEQ ID NO: 512
ZH12110/T7

NM_014597.1, U15552.1, AC005274.1, U41534.2, U20863.1, Z81586.1, Y11477.1, NC_001148.1, AE003673.1,
U18997.1, AC007576.3, AC001653.1, AE001573.1, AE000420.1, AF029714.1, AL163233.2, AL251790.2, U77617.1,
Z75529.1, Z73617.1, X07378.1, X15119.1, J02802.1, AP001688.1, AP000474.2, AP000371.1, AJ222744.1, V00262.1,
AW262098.1, AI811119.1, AI916666.1, AA588547.1, AI090265.1, AA559096.1, AA548959.1, AI078150.1, AI921686.1,
AI064798.1, AA512919.1, AI953413.1, AI584020.1, AI420425.1, AI440083.1, F24260.1, AA171691.1, AA223220.1,
AI589491.1, AI632721.1, AA191324.1, AW515936.1, AA180035.1, AW304051.1, AL291339.1, AI039210.1,
AW015039.1, AI039762.1, AA558329.1, AI630570.1, AW548819.1, AI436814.1, W38442.1, W44843.1, AA154111.1,
AW743841.1, T10610.1, AA900652.1, AW743746.1, AW822976.1, AW123455.1, AW368407.1, AW520538.1,
AW123632.1, AW107758.1, AU045884.1, AW368395.1, AW744309.1, AA163090.1, AI029049.1, AA408582.1,
AA266615.1, AA571872.1, AW579113.1, AA163319.1, AI125024.1, AA199338.1, C85561.1, AI929717.1, AA231163.1,
AW747936.1, AW163410.1, AW160946.1, AI872259.1, AA198766.1, AW368408.1, AV139960.1, AA090602.1,
AL267670.1, AW323159.1, AA615636.1, AV373964.1, AV241006.1, AI585726.1, AA140264.1, AV232403.1,
AW321909.1, AI926471.1, AA231166.1, AI426672.1, AA562711.1, AA458205.1, AA183585.1, AV294202.1,
AV321882.1, BB001603.1, AV307214.1, AA832262.1, AA718642.1, AV307617.1, AV324587.1, AV321231.1,
AV236999.1, AW136158.1, AA441847.1, AW838681.1, AV126308.1, AW175429.1, AI959131.1, AI957849.1,
AL049796.27, AC040952.1, AC011140.3, AC055112.1, AL138822.4, AL139005.1, AC012496.4, AC023332.3,
AC022266.3, AC019264.3, AC023995.2, AL138755.3, AL160235.1, AL009107.1, AC018356.8, AC011321.9,
AC069202.1, AC027484.3, AC027689.5, AC026784.2, AC020918.4, AC018756.3, AC016585.2, AC016608.4,
AC016638.4, AC008782.4, AC008767.4, AC026936.2, AC011121.4, AC055878.1, AC015960.4, AC015666.3,
AC021214.3, AC012433.5, AC024353.2, AC011584.4, AC023021.2, AC020758.1, AC016570.2, AC009862.3,
AC023083.2, AC009938.2, AC021110.2, AC022595.1, AC022025.1, AC012761.1, AL162495.3, AL139015.2,
AL136105.4, AL355477.1, AL162590.2, AL161897.3, AL035689.25, AL159972.3, AL158054.5, AP001499.1,
AP001390.1
SEQ ID NO: 513
ZH13410/T3

NM_014597.1, U15552.1, AL033375.2, AB018117.1, X78035.1, AC061957.3, AE003665.1, AC004541.1, AC004240.1,
AC000047.6, AC006215.1, AC003665.1, AC003658.1, Y12776.1, NM_014154.1, AE003463.1, AE002612.1, AC006825.1,
AC006679.2, AF161541.1, AF204231.1, AC004883.2, AC007736.3, AC005520.2, AC003019.1, AC004388.1,
AC003687.1, AF039586.1, AL163202.2, AL137686.1, AL117569.1, AL049749.2, AJ239318.3, Z99281.1, Z68006.1,
AL021786.1, AJ245583.1, AP001135.2, Z83733.1, AB020662.1, X68393.1, X71424.1, U04436.1, AW604388.1,
AW578439.1, AW604383.1, AA772816.1, AA171806.1, AA223318.1, X85657.1, AW366303.1, AW366304.1,
AW366300.1, AW366302.1, AW366308.1, AW106818.1, AI892034.1, AI790951.1, AA104392.1, AA098311.1,
AW323362.1, AI548718.1, AV239176.1, AW036673.1, AU085757.1, AW511512.1, AW470214.1, AW330749.1,
AW316831.1, AW196290.1, AW193248.1, AW190941.1, AW190241.1, AW190240.1, AW190240.1, AI958173.1,
AI928455.1, AI878341.1, AI858859.1, AI760032.1, AI695865.1, AI693200.1, AV005974.1, AI567745.1, AI496943.1,
AI475797.1, AI392330.1, AL206916.1, AL204039.1, AL204038.1, AI108782.1, AI081793.1, AI041845.1, AI017315.1,
AI004888.1, AA953940.1, AA847791.1, AA789537.1, AA440362.1, AA620779.1, AA610092.1, AA456818.1,
AA417164.1, AA257418.1, AA243360.1, W65778.1, W23329.1, H80920.1, AL049796.27, AL160163.3, AC026139.1,
AL159985.5, AC026674.4, AC058816.2, AC031988.2, AC026570.2, AC027580.1, AC012089.10,
AC021948.3, AC017053.5, AC021682.1, AC017550.1, AL139257.5, AL049180.3, AC069154.1, AC040992.2,
AC025678.2, AC027481.2, AC021822.3, AC021840.3, AC027261.1, AC021862.3, AC019314.2, AC011753.2,
AC017085.2, AC013725.2, AC016076.1, AL356318.1, AL121953.13, AL158825.6, AL352979.1, AP001496.1,
SEQ ID NO: 514
ZH141/T3

NM_014597.1, U15552.1, AL033375.2, AE003665.1, AC005534.2, AC007736.3, AC007385.3, AC006215.1, AC005968.1,
AL163202.2, AJ239318.3, AP001135.2, AP000604.1, AB023152.1, AW604388.1, AW578439.1, AA772816.1,
AW604383.1, AA171806.1, AA223318.1, AA300576.1, AW577851.1, AW784397.1, AW401090.1, AW401089.1,
AW400879.1, AW400878.1, AW330749.1, AI495597.1, AI392330.1, AA789537.1, AL049796.27, AL160163.3,
AL159985.5, AC021056.4, AC026674.4, AC009429.3, AC031988.2, AC027200.2, AC012089.10, AC022049.3,
AC023860.2, AC021682.1, AC012021.1, AL354933.1, AL158847.2, AC069154.1, AC019109.3, AC063969.1,
AC068159.1, AC023390.2, AC067978.1, AC067924.1, AC015979.3, AC007034.3, AC025917.3, AC012336.2,
AC011193.2, AC024739.3, AC026189.1, AC016100.4, AC016012.5, AC018822.3, AC009754.3, AC023232.3,
AC012460.3, AC021510.2, AC009878.3, AC017550.1, AC016076.1, AC012474.1, AC004480.7, AL133411.3,
AL355433.1, AL159141.1, AL136332.1
SEQ ID NO: 515
ZH141/T7

NM_014597.1, U15552.1, AC005274.1, AC004517.1, AC003972.1, AP001539.1, Y11477.1, NC_0011481 AC005169.2,
AE003815.1, AE003673.1, U18997.1, AC007576.3, AC006360.2, AC001653.1, AE001573.1, AE000420.1, AF029714.1,
AL163233.2, AL251790.2, Z75529.1, Z73617.1, X07378.1, X15119.1, I02802.1, AP001688.1, AP000474.2, AP000371.1,
AJ222744.1, V00262.1, X96547.1, AB009049.1, AW262098.1, AI811119.1, AI916666.1, AI090265.1, AA559096.1,
AA588547.1, AA548959.1, AI078150.1, AI921686.1, AA512919.1, AI064798.1, AI953413.1, AI440083.1, AI420425.1,
AI584020.1, F24260.1, AA171691.1, AA223220.1, AI589491.1, AI632721.1, AA191324.1, AW515936.1, AA180035.1,

TABLE 1-continued

Sequence homologies (GenBank Accession Numbers)

AL291339.1, AI039210.1, AW304051.1, AW015039.1, AI039762.1, AA558329.1, AI436814.1, AW548819.1, AI630570.1,
AA154111.1, W38442.1, W44843.1, AW743746.1, T10610.1, AW743841.1, AW822976.1, AA900652.1, AW123455.1,
AW520538.1, AW123632.1, AW107758.1, AU045884.1, AI029049.1, AA408582.1, AA266615.1, AW744309.1,
AW579113.1, AA571872.1, AA163090.1, AI125024.1, C85561.1, AA231163.1, AW368407.1, AW368395.1, AI929717.1,
AA199338.1, AW163410.1, AW160946.1, AI872259.1, AA163319.1, AA090602.1, AV139960.1, AL267670.1,
AI585726.1, AW323159.1, AV373964.1, AV241006.1, AA140264.1, AW368408.1, AA198766.1, AW321909.1,
AA231166.1, AV232403.1, AA615636.1, AI426672.1, AV294202.1, AV321882.1, AV307214.1, AA832262.1,
BB001603.1, AV307617.1, AV324587.1, AV321231.1, AV236999.1, AV136158.1, AA562711.1, AV126308.1,
AW747936.1, AA718642.1, AA458205.1, AA183585.1, AV365167.1, AV365148.1, AV061094.1, AW175429.1,
AI959131.1, AI957849.1, AL049796.27, AC040952.1, AC011140.3, AC055112.1, AC013448.3, AL139005.1,
AC023332.3, AC022266.3, AL138755.3, AL355100.1, AL160235.1, AL162832.1, AC069202.1, AC053493.4,
AC015960.4, AC012433.5, AC018401.2, AC010987.4, AC018520.2, AL354694.2, AL158037.6
SEQ ID NO: 516
Progestin Induced protein (DD5)/KIAA0896

AB020703.1, NM_015902.1, AF006010.1, X64411.1, AF029676.1, AF029675.1, AF151830.1, NM_016018.1,
AF230666.1, AE003557.1, AE003468.1, AF237948.1, AE003798.1, AE002987.1, U82806.1, AF052145.1, AC004345.1,
AC004298.1, Z97055.1, Z46918.1, M29295.1, AF145117.1, AC011229.2, AE003671.1, AE003480.1, AE003470.1,
AC008015.5, AC005836.2, AC004145.3, NM_003375.1, AC004787.1, AF152220.1, AC004185.1, AC006048.1,
AL163303.2, L06328.1, AL160371.1, Z83731.1, M20162.1, AP000509.1, D84394.1, K00046.1, D11474.1, AL042261.1,
AA183561.1, AA063910.1, AA177260.1, AA110008.1, AA727714.1, AW749472.1, AA087561.1, AI643062.1,
AL222185.1, AA800061.1, AA284046.1, R01391.1, AI986716.1, AI976300.1, AI975036.1, AI676486.1, AI533970.1,
AI395619.1, AI394872.1, AA990702.1, AA423063.1, T14459.1, AW650379.1, AW463925.1, AW140713.1, AW096747.1,
AW092707.1, AW041685.1, AI775589.1, AI774313.1, M774312.1, AI542582.1, AI533621.1, AI531106.1, AI530938.1,
AI411893.1, AL293423.1, AA123288.1, H31286.1, AW651695.1, AW247714.1, AV218869.1, AV212478.1, AW087404.1,
AL038544.1, AV089206.1, AI755888.1, AV007740.1, C96439.1, C96271.1, AI529204.1, AU039069.1, AU038173.1,
AA546255.1, AA386122.1, AA307929.1, AA207547.1, AA163566.1, AA146410.1, AA089612.1, AA087456.1, R75858.1,
R01776.1, AC021004.3, AF216669.1, AC009708.2, AC009622.4, AF228727.1, AC016768.4, AC018467.3, AC006591.12,
AC011907.2, AC0I9758.1, AC017811.1, AC008303.1, AL022475.12, AC022321.4, AC011181.5, AC017574.1,
AC018326.1, AL159982.5
SEQ ID NO: 517
ZH072/T3

AB020703.1, NM_015902.1, AF006010.1, X64411.1, AE002987.1, AFI45117.1, AC011229.2, AE003671.1, AC004185.1,
AC006048.1, AL163303.2, Z83731.1, M20162.1, AP000509.1, D84394.1, K00046.1, D11474.1, AL042261.1,
AA183561.1, AA063910.1, AA727714.1, AA110008.1, AA087561.1, AA177260.1, AI643062.1, AA123288.1,
AA546255.1, AA087456.1, R75858.1, AC021004.3, AF216669.1, AC009708.2, AC016768.4, AC018467.3, AC017574.1,
AL159982.5, AC015464.4, AC010027.4, AC060830.3, AC068706.2, AC025580.3, AC027148.2, AC053492.1,
AC037195.1, AC024530.3, AC008226.9, AC010575.3, AC01 0714.3, AC022186.2, AC015271.1, AC009886.2,
AL162413.3, AL162429.2, AL160276.2, AL157829.3, AL138721.3, AL138824.3, AL136455.2, AL133492.1
SEQ ID NO: 518
ZH072/T7

AC009223.2, AC005714.9, AF038584.1, AE000785.1, M28164.1, AE003694.1, AF124571.1, AC005698.1, AC007529.5,
AF129078.1, AL133162.2, Z81546.1, AL035475.6, AE003712.1, AF154675.1, AL161533.2, AL161503.2, AL133166.2,
Z77667.1, AL049638.1, AW301225.1, AI566211.1, AI446174.1, AW592514.1, AI963798.1, AI687963.1, AA582316.1,
AI830921.1, H27633.1, D63110.1, AW196550.1, AW028213.1, D62775.1, C01631.1, AA382517.1, H27554.1, I113230.1,
AA321967.1, I113597.1, AW427077.1, AA714833.1, AW427080.1, AI670697.1, AA827170.1, AW636393.1, AI108751.1,
AI107920.1, AL120021.1, AI172671.1, AI553602.1, AA938191.1, AA811984.1, AA651844.1, AA521315.1, AW333372.1,
AI249039.1, AC021004.3, AC009708.2, AC010802.4, AC061710.4, AC023281.9, AC017902.1, AC017105.5,
AC051647.2, AC058823.2, AC009902.3, AC018735.5, AC018465.3, AC007692.3, AL139097.5, AL035087.18,
AC010350.3, AC024437.2, AC012510.3, AC022180.1, AC013620.2, AC013681.1
SEQ ID NO: 519
ZH095/T3

AB020703.1, NM_015902.1, AF006010.1, AF029676.1, AF029675.1, AF151830.1 NM_016018.1, AF230666.1,
AE003557.1, AE003468.1, AF237948.1, AE003798.1, U82806.1, AF052145.1, AC004345.1, AC004298.1, Z97055.1,
Z46918.1, M29295.1, AE003480.1, AE003470.1, AC008015.5, AC005836.2, AC004145.3, NM_003375.1, AC004787.1,
AF152220.1, L06328.1, AL160371.1, AA183561.1, AA063910.1, AL042261.1, AA177260.1, AA110008.1, AW749472.1,
AL222185.1, AA727714.1, AA800061.1, AA284046.1, R01391.1, AI986716.1, AI976300.1, AI975036.1, AI676486.1,
AI533970.1, AI395619.1, AI394872.1, AA990702.1, AA423063.1, T14459.1, AW650379.1, AW463925.1, AW140713.1,
AW096747.1, AW092707.1, AW041685.1, AI775589.1, AI774313.1, AI774312.1, AI542582.1, AI533621.1 AI531106.1,
AI530938.1, AI411893.1, AL293423.1, H31286.1 AW651695.1, AW247714.1, AV218869.1, AV212478.1, AW087404.1,
AL038544.1, AV089206.1, AI755888.1, AV007740.1, C96439.1, C96271.1, AI529204.1, AU039069.1, AU038173.1,
AA386122.1, AA307929.1, AA207547.1, AA163566.1, AA146410.1, AA089612.1, R01776.1, AC021004.3, AF216669.1,
AC009708.2, AC009622.4, AF228727.1, AC016768.4, AC018467.3, AC006591.12, AC011907.2, AC019758.1,
AC017811.1, AC008303.1, AL022475.12, AC022321.4, AC011181.5, AC018326.1, AL159982.5, AC012325.5,
AC027393.2, AC007318.3, AC012590.3, AC027148.2, AC046775.1, AC026048.2, AC025498.2, AC018421.3,
AC019291.4, AC015525.3, AC023462.2, AC010747.3, AC014119.1, AC015395.1, AC006106.1, AL353791.2,
AL353729.2, AL354747.3, AL157996.2, AL137069.1
SEQ ID NO: 520
ZH095/T7

AF090904.1, AK002172.1, AB020703.1, X64411.1, NM_015902.1, AF006010.1, AB005233.1, NM_016593.1,
AF237982.1, AE003600.1, AE003470.1, NM_0133371 AF155330.1, AC005597.1, U89959.1, AL035670.29, Z86075.1,
AL035469.7, AL009174.1, AK000830.1, AB026649.1, AC007551.1, AC002521.2, AC006036.3, AF117829.1,
AF034470.1, AF034464.1, AL163152.2, AF016418.1, AL034582.11, Z71263.1, AL021492.1, Z75551.1, AL031673.16,

TABLE 1-continued

Sequence homologies (GenBank Accession Numbers)

Z86063.1, Y14082.1, AB022215.1, AB016891.1, Z99109.1, U69567.1, M125532.1, AW274041.1, AA434064.1,
AI569610.1, AA610288.1, AI041022.1, AW778740.1, AW264922.1, AW471208.1, M411395.1, W95811.1, AI332805.1,
AA894186.1, AW474117.1, AI024731.1, AA843441.1, AI469526.1, AW473231.1, W95857.1, AL237592.1, W95818.1,
AA725577.1, AI376892.1, AL237601.1, AL233371.1, AW268885.1, AW675227.1, N20661.1, AW149140.1, AW104291.1,
AL231043.1, AW580433.1, AW317070.1, AA927329.1, AA627267.1, AA128632.1, D45459.1, AI685703.1, M675470.1,
AA554058.1, AI689250.1, AA905245.1, AA850460.1, AA757169.1, AA588884.1, AA504225.1, AA955278.1,
AW522026.1, AA956416.1, AI364772.1, I72574.1, AA851563.1, AA058906.1, AA646569.1, AA467485.1, AI137-214.1,
AW385164.1, AA043863.1, AW549941.1, AA076485.1, AI157047.1, AA170365.1, AA824035.1, AA712101.1,
AA621776.1, AI847142.1, AU020445.1, AU016788.1, AA122804.1, AW489114.1, AA169470.1, C77315.1, AW215446.1,
N29038.1, AA154114.1, AA075669.1, AA475847.1, AW481686.1, AW364486.1, AI596391.1, AW744029.1, AA538098.1,
AA873964.1, AI325477.1, AA369775.1, AV125774.1, AV250017.1, AV320673.1, AA254612.1, AV247937.1,
AV355877.1, AV370222.1, H88855.1, AV247745.1, AF074692.1, AI110785.1, R70621.1, AJ397051.1, AA546580.1,
AC021004.3, AF216669.1, AC062012.1, AL355813.3, AL355587.3, AC026093.3, AC034199.3, AC066615.2,
AC064813.1, AC019215.3, AC009704.3, AC021568.4, AC015526.3, AC015994.3, AC019253.3, AC020704.3,
AC011710.2, AC024660.2, AC020992.3, AC010211.8, AC019077.4, AC022201.2, AC019799.1, AC013185.1,
AL157405.2, AC068706.2, AC053537.3, AC025461.3, AC016639.5, AC016632.4, AC036111.2, AC008730.4,
AC061711.2, AC027497.2, AC009870.3, AC018891.2, AC016796.2, AC024627.1, AL353145.2, AP001830.1, AP001167.1
SEQ ID NO: 521
TRANSCRIPTION FACTOR 6-Like 1

NM_003201.1, M62810.1, X64269.1, NM_012251.1, AB014089.1, NM_009360.1, U63859.1, U63858.1, U57939.1,
L07107.1, U63860.1, AL034386.2, AC009079.4, U35728.1, AC004695.1, AL022239.1, U91323.1, AC022073.13,
AC0079703 NM_014362.1, AC006552.7, U66669.1, AF013711.1, AF020932.1, AC002563.1, U73638.1, AL008635.1,
M58484.1, AC006038.2, AC018655.5, AC007911.8, AC004991.1, AF096371.1, AC007123.1, U14101.1, AP001434.1,
M928504.1, AW340722.1, AW269796.1, AI769813.1, AA625849.1, AI862124.1, AA449551.1, AA995790.1,
AA758646.1, AW303542.1, AA102499.1, M473739.1, AI090110.1, AW666007.1, AA398622.1, AI374841.1, AI375548.1,
AI394089.1, AA216389.1, AI581299.1, AI921516.1, AL214404.1, AA150885.1, AI653196.1, AL203433.1, AW195686.1,
C02893.1, AA554544.1, AW089045.1, AA933956.1, AW629507.1, AA992949.1, AA705964.1, AI347250.1, AI637679.1,
C05423.1, C04410.1, AA847971.1, AA229416.1, AW176737.1, H18558.1, AW176739.1, AI694296.1, AW136263.1,
AW085017.1, c04272.1, AL261738.1, C05173.1, AA382285.1, AI521377.1, AI424979.1, AW663732.1, AW339172.1,
AI942242.1, AI800325.1, AI375299.1, AI357116.1, AI093643.1, AI092542.1, AA814953.1, AA742275.1, AA449118.1,
AA316997.1, W93827.1, AW055117.1, AA989453.1, AI810160.1, AI860878.1, AA150777.1, H18451.1, AA779848.1,
AA503492.1, AI480401.1, AA380917.1, AW119042.1, AI950385.1, AI382337.1, AA808771.1, F05367.1, AA766240.1,
T15871.1, AI472592.1, N84674.1, D56945.1, AI696377.1, AW235470.1, AA828857.1, AA649140.1, AA936191.1,
AL048975.1, AI138753.1, F01619.1, AI478145.1, W93826.1, AW407620.1, AA082140.1, D56745.1, AI970145.1,
T28290.1, AI761167.1, AC023170.3, AC011786.5, AC016293.2, AC022065.2, AP002006.1, AP001981.1, AL355293.2,
AC011389.5, AC009427.2, AC025903.1, AC016800.2, AC0118443, AC009070.5, AC009305.1, AC024306.3,
AF206725.1, AC020893.4, AC025778.2, AC025277.2, AC019265.3, AL354877.2, AL138729.1, AP000471.1,
AC067839.1, AC018519.3, AC044902.2, AC067966.2, AC021523.3, AC01 0735.3, AC004937.1, AL355871.1,
AL353705.1, AL352977.1, AL079307.4, AC031976.3, AC016856.3, AC024444.2, AC021148.4, AC018360.7,
AC023718.2, AL139014.3
SEQ ID NO: 522
ZH034/T3

NM_003201.1, M62810.1, AB014089.1, NM_009360.1, U63860.1, U63859.1, U63858.1, U57939.1, L07107.1, U35728.1,
AC016026.13, AC016025.12, AC007845.12, NC_001138.1, AF135799.1, U51994.1, U05814.1, D50617.1, D31600.1,
L00602.1, NC_001144.1, AC005309.2, AE003513.1, AE003904.1, AC002040.1, NM_005410.1,
AC005832.1, AF000657.1, U19027.1, AL161544.2, Z47073.1, AL132862.1, AL110502.1,7,83230.1, Z70781.1,
AL022097.1, Z97341.2, Z11793.1, AB005246.1, AW269796.1, AI928504.1, AA150885.1, AA992949.1, AW340722.1,
AW666007.1, AI769813.1, AI374841.1, AI375548.1, AW176737.1, AI581299.1, AL214404.1, AL203433.1, AA933956.1,
AA758646.1, AA625849.1, AW176739.1, C05173.1, AW136263.1, AI862124.1, AA995790.1, AA382285.1, AI473739.1,
AA554544.1, AI950385.1, AA705964.1, AW085017.1, AI472592.1, AI347250.1, AI394089.1, AA398622.1, AI138753.1,
AA828857.1, AA936191.1, AA150777.1, AL261738.1, AI694296.1, AI027655.1, AW360354.1, AA989453.1, AA837665.1,
AW303542.1, AI893658.1, AI182485.1, AA939510.1, AA261330.1, AA041749.1, AI026148.1, AA879876.1,
AW235470.1, AV266273.1, AI480401.1, AA028254.1, AW200061.1, AI810160.1, AV045619.2, AA380917.1,
AI393272.1, AV044416.2, AI050306.1, AI021090.1, AA531437.1, W36799.1, W36911.1, AV440927.1, AW338019.1,
AW337174.1, AW269901.1, AW264523.1, AW244106.1, AW242955.1, AW130918.1, AW103736.1, AW020023.1,
AI979233.1, AI925560.1, AI880823.1, AI799625.1, AI679731.1, AI632008.1, AI151234.1, AI024512.1, AA988412.1,
AA977782.1, AA845625.1, AA843453.1, AA805646.1, AA716432.1, AA576243.1, AA506199.1, N78747.1, AC023170.3,
AC011786.5, AC022065.2, AP002006.1, AP001981.1, AL138729.1, AP000999.2, AP000802.1, AC009188.4,
AC067785.1, AC019169.3, AL158079.5, AL157946.2, AC04.6132.4, AC025035.5, AC016182.3, AC011223.5,
AC008945.3, AC068314.1, AC026653.2, AC040919.1, AC021561.3, AC024060.2, AC023812.3, AC013486.2,
AC021808.3, AC005506.6, AC020751.2, AC018812.3, AC023633.1, AC023939.2, AC019315.2, AC015347.1,
AC012877.1, AC005540.2, AC004060.1, AL139192.3, AL138901.2, Z94158.1, AL133473.4, AL022285.6, AP001845.1,
AP001490.1, Z92820.1
SEQ ID NO: 523
ZH034/T7

NM_003201.1, M62810.1, AL034386.2, AC009079.4, AC004695.1, AL022239.1, U91323.1, AL163304.2, AL031012.1,
AP001759.1, AC008873.4, AC022073.13, AC007970.3, AL121586.28, NM_014362.1, AC009310.3, AE002743.1,
AC007917.15, U66669.1, AF013711.1, AF020932.1, U73638.1, AL049712.12, AC006012.2, AC004991.1, AC007568.1,
AC006010.2, AC023721.1, U14101.1, AL161532.2, AL132952.1, AL078606.1, Z93018.1, AL035522.1, AB037120.1,
AB037119.1, AB013915.1, AB022126.1, AC011362.2, NC_000895.1, AC009784.2, AC007041.3, AL163216.2,
AL163205.2, AL139076.2, AL031674.1, Z99495.1, Z99708.1, U67917.1, U30821.1, AB000109.1, AP001671.1,
AP001660.1, AP001347.1, AI694296.1, AJ862124.1, AI394089.1, AI521377.1, M424979.1, AW663732.1, AW339172.1,
AI942242.1, AI800325.1, AI473739.1, AI375299.1, AI357116.1, AI093643.1, AI092542.1, AA814953.1, AA742275.1,
AA449118.1, AA316997.1, W93827.1, AW055117.1, AI810160.1, AA989453.1, AI860878.1, H18451.1, AA779848.1,

TABLE 1-continued

Sequence homologies (GenBank Accession Numbers)

AA380917.1, AA503492.1, AI928504.1, AA995790.1, AW119042.1, AI480401.1, AL261738.1, AI347250.1, AI382337.1,
AI769813.1, AA808771.1, AA766240.1, T15871.1, D56945.1, AA705964.1, AI696377.1, AA150777.1, AA554544.1,
AA649140.1, AW235470.1, F01619.1, AW269796.1, AW666007.1, AW085017.1, M581299.1, AI375548.1, AI374841.1,
AI478145.1, W93826.1, D56745.1, AA082140.1, L28290.1, AI026148.1, AI761167.1, AI669271.1, AA828857.1,
AA936191.1, AI472592.1, AA642393.1, AA669592.1, AA102838.1, AA931943.1, AI029587.1, AI411675.1, AI103586.1,
AW614266.1, AW302221.1, AW243362.1, AI984813.1, AI927995.1, AV159002.1, AI768695.1, M767426.1, AI743954.1,
AI695241.1, AI691032.1, AI569800.1, AI554228.1, AI470575.1, AI375081.1, AI076773.1, AA835045.1, AA243331.1,
AA102839.1, AV368179.1, AC023170.3, AC011786.5, AC022065.2, AP002006.1, AP001981.1, AL355293.2,
AC011389.5, AC009427.2, AC025903.1, AC016800.2, AC011844.3, AC009070.5, AC009305.1, AC022331.5,
AF206725.1, AC008972.5, AC005515.5, AC025778.2, AC025277.2, AC027598.1, AC013607.3, AC020960.1,
AL354877.2, AP000471.1, AC037443.2, AC067839.1, ACJ023857.2, AL096793.14, AC044902.2, AC067749.2,
AC008728.4, AC005079.2, AC010087.3, AC034169.2, AC021523.3, AC004937.1, AL352977.1, AL161665.1,
AC018700.3, AC020704.3, A0016186.3, AC023718.2, AC019245.2, AC018860.2, AC006714.2, AL031823.10,
AC046198.2, AC036199.2, AC019206.3, AC023137.2, AC040890.1, AC025708.3, AC024411.2, AC004688.6,
AC2004709.3, AL161796.3, AL353617.1, AP001109.1
SEQ ID NO: 524
ZH1312/T3

NM_003201.1, M62810.1, X64269.1, NM_012251.1, AB014089.1, NM_009360.1, U63859.1, U63858.1, U57939.1,
L07107.1, U63860.1, AF125313.1, AC013430.4, AC007911.8, AF089242.1, AL163276.2, AL117352.12, U71395.1,
U27809.1, AP001731.1, AP001438.1, AP001434.1, AP000162.1, AP000020.2 NC_001138.1, AC009478.4, AE003797.1,
AC007627.3, A.D007633.3, AF141883.1, AF101268.1, AE001696.1, AC003950.1, AC004806.1, AC005815.1, U62306.1,
AL355928.1, AL163255.2, AJ288911.1, AJ288910.1, AJ288909.1, AJ288908.1, AL133162.2, AL161831.1, AL161540.2,
AL161515.2, AL021069.1, AL031774.1, Z75208.1, Z97337.2, D50617.1, AP001710.1, X06180.1, M37271.1, D00747.1,
AP000208.1, AP000247.1, AP000130.1, AB020869.1, D31600.1, Z99118.1, D10681.1, D10680.1, L00602.1, AA449551.1,
AW303542.1, AA102499.1, AI090110.1, AA216389.1, AI921516.1, AI653196.1, AW195686.1, C02893.1, AW089045.1,
AW629507.1, AI637679.1, C05423.1, C04410.1, AA398622.1, AA847971.1, AA229416.1, HI 8558.1, AW340722.1,
AA625849.1, C04272.1, AA758646.1, F05367.1, N84674.1, AL214404.1, AL048975.1, AL203433.1, AA933956.1,
AW407620.1, AI970145.1, AA393273.1, AW136263.1, AA382285.1, AW176737.1, AW176739.1, AL022880.1,
AI787961.1, AI786086.1, AI528469.1, AI324462.1, AA711556.1, AA517909.1, AA474993.1, W89803.1, AA028254.1,
W62315.1, AA921601.1, AA522358.1, AA122613.1, AV213620.1, AW012804.1, AA261330.1, AI138753.1, AW557486.1,
AW554744.1, AW553689.1, AW344069.1, AV263786.1, AI437369.1, AW756512.1, AW756019.1, AW203407.1,
AW203346.1, AV338708.1, AI966444.1, AI726437.1, AI725235.1, AI670698.1, AI484148.1, AC011786.5, AC023170.3,
AC016293.2, AC022065.2, AP002006.1, AP001981.1, AC026307.7, AC011214.2, AC009570.7, AC068063.2,
AC024925.2, AC025429.2, AC016768.4, AC011945.3, AC020658.3, AC016397.4, AC015869.1,
AC009709.4, AC011953.2, AL138729.1, AC027613.2, AC012149.5, AC068788.3, AC055748.5, AC022224.19,
AC068615.2, AC036121.2, AC048375.2, AC026731.3, AC037198.3, AC034268.2, AC022787.3, AC012258.3,
AC017087.4, AC026612.2, AC021590.3, AC007601.2, AC023403.2, AC011632.3, AC011733.4, AC019228.4,
AC016732.2, AC012408.3, AC022865.2, AC008188.3, AC009863.2, AC018184.1, AC007644.1, AL355342.2,
AL138825.3, AL355601.1, AL157400.1
SEQ ID NO: 525
ZH1312/T7

NM_003201.1, M62810.1, AL034386.2, AC009079.4, AC004695.1, AL022239.1, U91323.1, AL163304.2, AL031012.1,
AP001759.1, AC008873.4, AC022073.13, AC007970.3, AL121586.28, NM_014362.1, AC009310.3, AE002743.1,
AC007917.15, U66669.1, AF013711.1, AF020932.1, U73638.1, Z94044.1, M58484.1, AC006012.2, AC004991.1,
AC007568.1, AC007123.1, U14101.1, AL161532.2, AL078606.1, Z93018.1, AL035522.1, AB037120.1, AB037119.1,
AB013915.1, AB022126.1, AC011362.2, NC_000895.1, AC009784.2, AC007041.3, AL163216.2, AL163205.2,
AL139076.2, Z70311.1, AL031674.1, Z99495.1, Z99708.1, U67917.1, AB000109.1, AP001671.1, AP001660.1,
AP001347.1, AI694296.1, AI862124.1, AI394089.1, AI521377.1, AI424979.1, AW663732.1, AW339172.1, AI942242.1,
AI800325.1, AI473739.1, AI375299.1, AI357116.1, AI093643.1, AI092542.1, AA814953.1, AA742275.1, AA449118.1,
AA316997.1, W93827.1, AA989453.1, AW085117.1, AI810160.1, AI860878.1, AA380917.1, H18451.1, AA779848.1,
AA503492.1, AI928504.1, AI480401.1, AA995790.1, AW119042.1, AL261738.1, AI382337.1, AI347250.1, AI769813.1,
AA808771.1, AA766240.1, T15871.1, D56945.1, AA705964.1, AI696377.1, AA150777.1, AA554544.1, AW235470.1,
AA649140.1, F01619.1, AI478145.1, AW269796.1, AW666007.1, AW085017.1, AI581299.1, AI375548.1, AI374841.1,
W93826.1, AA082140.1, D56745.1, T28290.1, AI026148.1, AI761167.1, AI669271.1, AA936191.1, AA828857.1,
AI472592.1, AA642393.1, AA669592.1, AA102838.1, AI029587.1, AI411675.1, AI103586.1, AW614668.1, AW614266.1,
AW612554.1, AW572783.1, AW270957.1, AW243362.1, AI984813.1, AI823757.1, AI784606.1, AI695241.1, AI691032.1,
AI470941.1, AI375081.1, AL287805.1, AL217260.1, AI051344.1, AA888026.1, AA815394.1, AA628961.1, AA190577.1,
AV368179.1, AC023170.3, AC011786.5, AC022065.2, AP002006.1, AP001981.1, AL355293.2, AC011389.5,
AC009427.2, AC025903.1, AC016800.2, AC011844.3, AC009070.5, AC009305.1, AC022331.5, AF206725.1,
AC008972.5, AC008515.5, AC025778.2, AC025277.2, AC027598.1, AC013607.3, AC020960.1, AL354877.2,
AP000471.1, AC037443.2, AC067839.1, AL096793.14, AC044902.2, AC067749.2, AC008728.4, AC005079.2,
AC010087.3, AC034169.2, AC021523.3, AC004937.1, AL352977.1, AL161665.1, AC018360.8, AC055841.2,
AC018700.3, AC031976.3, AC023718.2, AC018860.2, AL239319.3, AC046198.2, AC036199.Z AC019206.3,
AC023137.2, AC040890.1, AC025708.3, AC024411.2, AC019007.3, AC004688.6, AC011566.3, AC023942.2,
AC004709.3, AL160261.4, AL161796.3, AL353617.1, AL136298.1
SEQ ID NO: 526
ZH1386/T3

NM_014890.1, U53445.1, AC004020.1, AE003832.1, AC012039.10, Z82203.1, X52075.1, M61827.1, AC011456.2,
AE003629.1, AC004595.1, AF104477.1, AC005547.1, U60149.1, AF003530.1, AC0004.03.1, AL079304.2, AL096867.15,
Z82268.1, AL049692.13, MO11002.1, M32612.1, AF166025.1, AF130358.2, AC008166.2, AC004021.1, AC015985.8,
AC007560.3, AC004125.1, AC005046.3, U41274.1, AF130342.1, L14323.2, AP112922.1, IJ85714.1, U85713.1,
U85712.1, AF098991.1, M57500.1, U53325.1, AC003070.1, AL163206.2, AL078459.8, AL035458.35, AL021807.1,
AL022717.1, Z82899.1, AL096769.7, U64852.1, X15742.1, M26915.1, M20636.1, AB020865.1, M13798.1, M96739.1,
AW867011.1, AI642381.1, AW779584.1, AW779590.1, AW779587.1, AA611335.1, C05084.1, AI606223.1, AW779641.1,

TABLE 1-continued

Sequence homologies (GenBank Accession Numbers)

AV292155.1, AA611336.1, AI549138.1, AI554667.1, AI553756.1, AI402221.1, M202123.1, AI084203.1, AI614167.1,
C55082.1, AA497874.1, AA196522.1, AW871954.1, AW208053.2, AW459498.1, AW439057.1, AV369587.1,
AV339384.1, AV259982.1, AV245839.1, AW076711.1, AI733300.1, AI733105.1, AA910905.1, AA623952.1,
AA537555.1, AA387953.1, AA386853.1, AA274292.1, H09936.1, AC022883.3, AC024938.7, AC069222.1, AC010324.4,
AC009086.4, AC023831.3, AC025231.2, AC007330.5, AC035178.1, AC010696.2, AL161632.4, AL158145.4,
AL132989.1, AL157819.2, AC048376.2, AC058820.2, AC022263.4, AC004906.2, AC053533.1, AC027233.2,
AC012056.3, AC026536.1, AC023613.1, AC014353.1, U82207.1, AL353632.4, AL136380.2, AL162389.3, AL118524.25,
AC055879.2, AF267167.1, AC009794.3, AC013808.3, AC021114.3, AC024353.2, AC017103.3, AL355352.3,
AL137016.10, Z82191.1, AP001026.1
SEQ ID NO: 527
ZH1386/T7

NM_014890.1, U53445.1, L16887.1, AC009294.8, AB005241.1, AE003474.1, AE003418.1, AC004885.2, AC010175.4,
AC004061.1, AL031583.2, AF096863.1, AF132287.1, AC022492.5, AE003811.1, AC007843.6, U91323.1, AC007630.3,
AF099917.1, AL158088.6, AL034399.6, U49947.1, X95276.1, AJ007556.1, AI435598.1, AI810391.1, AI435391.1,
AW303392.1, AI921737.1, AI401231.1, AA576134.1, AI635663.1, AA424880.1, AI016121.1, AW058260.1,
AW026643.1, AI817224.1, AI139164.1, AI086061.1, D57964.1, AI185109.1, AA430212.1, AW295168.1, AA973230.1,
AA609225.1, AW058427.1, AA857729.1, AI394490.1, AI783720.1, AI378381.1, AI334138.1, AI701330.1, AW083745.1,
AI335721.1, AI378578.1, AI431237.1, AI804232.1, W69790.1, AI803115.1, AW118656.1, AA033582.1, AA258605.1,
AI013647.1, AW413495.1, AA463851.1, AI371463.1, AA033581.1, AA925088.1, AA795013.1, AA256689.1, AI381752.1,
F27521.1, R78245.1, AA568101.1, AA030472.1, D58330.1, D57334.1, AA710489.1, AA241058.1, D57996.1,
AA217400.1, AA445957.1, C16405.1, C16415.1, AI473313.1, AW363711.1, AW346548.1, Z21882.1, AA891483.1,
F37351.1, AA986888.1, AA432784.1, AA266373.1, AA204051.1, AW582813.1, AI464359.1, AW214616.1, AV234619.1,
AV248227.1, T84055.1, AW437163.1, AA170494.1, AW363682.1, AV229961.1, AA255796.1, AA463341.1,
AV343730.1, AA515391.1, AA546804.1, AA930120.1, AI181464.1, AA172829.1, AL258437.1, AJ280472.1,
AW373694.1, AV203822.1, AA570905.1, D66306.1, AC069222.1, AC022883.3, AC024938.7, AC023911.4, AC012512.2,
AC026770.3, AC020685.3, AC025666.2, AC026813.1, AC010014.5, AC014946.1, AC020107.1, AC010015.3,
AL354827.1, AC018361.7, AC018473.10, AC044869.2, AC068725.1, AC010628.3, AC068595.1, AC026452.4,
AC012321.4, AC009032.5, AC068055.1, AC027301.3, AC021537.3, AC023549.2, AC009635.4, AC012580.3,
AC016130.13, AC018432.4, AC024007.2, AC024006.2, AC008342.11, AC018361.6, AC017903.1, AC009598.2,
AC008004.4, AC009741.4, AL355315.2, AL356272.1, AL161632.4, AL354710.2, AL354669.1, AL161434.3,
AL160274.2, AL158143.1, AL158063.1, AP000904.2, AP001829.1, AP000706.1
SEQ ID NO: 528
ZH1394/T3

NM_015642.1, AL050276.1, AF194030.1, AP185576.1, AL121985.13 NM_006585.1, AC006972.2, AC006384.2,
AF177669.1, AC004828.2, AC007052.4, AC005144.1, AL355736.1, AL163249.2, Z68161.1, AL251713.1, AJ251712.1,
AL033538.1, AL035415.22, Z68332.1, AL035073.4, D42052.1, D13627.1, AW502748.1, AA578163.1, AA069836.1,
AW237166.1, I185064.1, AW611145.1, AW106649.1, AI828036.1, AL221632.1, AA464297.1, AI151799.1, AW673083.1,
AW618417.1, AW362358.1, AW362276.1, AW362252.1, AW247278.1, AW213355.1, AI648841.1, AI641856.1,
AA984168.1, AA871508.1, AA385412.1, AA347604.1, H88667.1, AC027493.2, AC069063.1, AC026560.4, AC055739.2,
AC025358.3, AC036131.2, AC041009.1, AC034154.1, AC027790.1, AC012056.3, AC024606.2, AC021712.3,
AC022736.2, AL161444.2, AP001959.1, AC069102.1, AC068656.1, AC025763.2, AC027082.2, AC011741.3,
AL137021.3, AL136990.14, AC024935.8, AC025028.8, AC036153.2, AC046168.2, AC016481.4, AC020930.4,
AC008939.3, AC008839.4, AC036127.2, AC037456.4, AC022218.4, AC034167.2, AC026542.2, AC011026.3,
AC021506.3, AC034119.1, AC018943.4, AC011175.4, AC011853.3, AC012571.3, AC015474.3, AC025009.2,
AC009899.5, AC020588.4, AC013817.4, AC011642.5, AC023103.3, AC024340.1, AC015950.2, AC017056.3,
AC021047.2, AC019648.1, AC015579.2, AC015675.1, AC007432.7, AC009437.1, AP129075.1, AC00fl55.1,
AL356137.2, AL356322.1, AL162716.4, AL160265.4, AL355386.1, AL354778.1, AL137074.4, AC002099.1, AL158826.2,
AP001841.1, AP001569.1, AP001365.1, AP001356.1, AP001095.2
SEQ ID NO: 529
ZH1394/T7

NM_015642.1, AL050276.1, AF194030.1, AP185576.1, AC008372.6, AC005874.3, AC007766.1, AF134471.1, D88148.1,
AE003835.1, AC007225.2, AL133258.16, AL163225.2, AL135858.2, AL034559.3, Z96810.1, AP001680.1, AP001138.2,
AA834935.1, AW293260.1, AI798849.1, AL240155.1, AA083812.1, N26227.1, AA930334.1, AI809178.1, AA828063.1,
AA943003.1, AW108541.1, AI551088.1, AI626969.1, AI445139.1, N71750.1, N99462.1, AV028027.1, AI809910.1,
AA613636.1, AV137484.1, AV329304.1, AV329353.1, AV330564.1, AI610886.1, T12777.1, AW115543.1, AA544682.1,
AA472454.1, AA465787.1, AA119039.1, AA024136.1, W29276.1, R93225.1, H02904.1, AW772943.1, AW489077.1,
AC068938.1, AC016803.2, AC068072.7, AC025676.2, AC021032.3, AC068659.1, AC010374.4, AC036186.2,
AC010287.5, AC009164.3, AC009130.5, AC009093.5, AC008758.3, AC027250.2, AC046150.2, AC024721.4,
AC007615.3, AC021792.2, AC025394.2, AC012111.3, AC009270.2, AC015958.3, AC017038.5, AC023980.2,
AC010583.3, AC022023.2, AC018792.2, AC011279.1, AL157833.5, AL136172.14, AL355594.3, AL135903.2,
AL033383.25, AL158014.4, AL160280.2, AL157827.3, AL133848.1, AL138831.2, AL157883.2, AL136309.3,
AL133461.2, AP001780.1, AP000853.1, AP000580.2, AC012520.8, AC046140.4, AC026763.5, AC048337.4,
AC068972.1, AC067852.1, AC020903.3, AC008699.4, AC027810.2, AC025875.3, AC068382.1, AC021443.5,
AC026938.2, AC022715.2, AC021369.3, AC024883.3, AC025311.2, AC019313.3, AC024619.2, AC020372.1,
AC012281.1, AC007896.1, AL356289.2, AL096855.24, AL354934.1, AL139806.3, AL158058.1, AL139427.1,
AL136095.4, AP000874.1
SEQ ID NO: 530
ZH1401/T3

AF005067.1, AL080149.1, Z98885.1, X64746.1, X64745.1, AF203193.1, AF203192.1, AP203160.1, AF203138.1,
AF203137.1, AF203118.1, AF129334.1, U37269.1, U37268.1, AF064681.1, AP064.680.1, AF064679.1, AP064678.1,
U23487.1, AK000751.1, AB033112.1, M58271.1, M58270.1, M58269.1, M58268.1, M58267.1, M58266.1, M58265.1,
M58264.1, M58263.1, M58262.1, M58261.1, M58260.1, M58259.1, M58258.1, M58257.1, M58256.1, M58255.1,
M58254.1, M58251.1, M58212.1, M58207.1, M58200.1, M58194.1, M58186.1, M58183.1, M58179.1, AF203182.1,

TABLE 1-continued

Sequence homologies (GenBank Accession Numbers)

AF110401.1, U27443.1, AF066970.1, NM_006751.1, AF203140.1, AF203139.1, AF203122.1, AF203120.1, AF203119.1,
AF174703.1, AF174702.1, AF174701.1, AF174700.1, AF174699.1, AF174698.1, AF174697.1, AF174696.1, AF174694.1,
AF174693.1, AF174692.1, AF079325.1, AF120917.1, AF120916.1, AF120915.1, AF120914.1, AF120913.1, AF120912.1,
AF120909.1, AF129381.1, U03340.1, U03338.1, U84848.1, U84811.1, AF029776.1, AF082358.1, AL035703.20,
AL022103.1, M61199.1, Z11812.1, U16868.1, U16866.1, U16864.1, AJ233022.1, AJ233020.1, L15492.1, L15491.1,
L15490.1, L15489.1, AL040577.1, AW408719.1, AL041903.1, AA340707.1, H11686.1, M79139.1, H11889.1,
AJ397954.1, AA759003.1, AW752395.1, AW375924.1, AL047827.1, AI514970.1, AA990859.1, AA948792.1,
AA428908.1, AA325161.1, AA187577.1, AA158452.1, AA045603.1, AW598032.1, AW410598.1, AW289794.1,
AV391484.1, AW047869.1, AI969973.1, M948717.1, AI710520.1, AI705195.1, AI499756.1, AI454951.1, AI029325.1,
AA859441.1, AL263045.1, AI75427.1, AI175396.1, AI170788.1, AI103955.1, AI076494.1, AI076474.1, AA843382.1,
AA448354.1, AL160033.6, AL162499.3, AC020909.4, AL079336.13, AL138703.2, AC010789.8, AC048356.2,
AC024591.2, AC009108.6, AC023592.2, AC025929.2, AC021769.3, AC016774.2, AC020962.1, AC009962.3,
AC007328.4, AC020260.1, AL354919.5, AL133420.24, AL138809.14, AL139160.1, AC013251.7, AC010177.4,
AC026765.5, AC068785.4, AC021151.6, AC023524.4, AC025862.2, AC022559.3, AC013614.4, AC016841.2,
AC015844.4, AC013562.3, AC012109.2, AC018699.2, AC012354.3, AC018758.1, AC016246.1, AC013590.1,
AL139384.3, AL355372.2, AL162711.4, AL355804.2, AP001007.1, Y12335.1
SEQ ID NO: 531
ZH1401/T7

AF005067.1, AL049402.1, Z98885.1, AL080149.1, AJ276620.1, Z77661.1, AC010143.3, AE003520.1, AE001419.1,
AC004186.1, Z98551.1, AL137226.2, AL139165.1, AL031407.3, AP000517.1, AB023055.1, AB023054.1, AC008082.12,
AC005293.1, AC002984.1, AL163231.2, Z97348.1, AL117204.1, AL137082.1, AP001686.1, AI912611.1, AA194257.1,
AW511409.1, AI350842.1, AI497969.1, AI991928.1, AW367919.1, AI061156.1, AI697635.1, AA744999.1, D53392.1,
H11244.1, AI680322.1, T07017.1, AU021249.1, AW464067.1, AA675465.1, AU021226.1, H07921.1, AA675514.1,
AA096761.1, AI316859.1, AA675570.1, H11599.1, AA415581.1, AI605086.1, AA140518.1, AA407537.1, AA423260.1,
L26667.1, AV232516.1, AV308339.1, AI136270.1, AV362645.1, AV232046.1, AV221817.1, AV309058.1, AA538272.1,
AV295672.1, AA881466.1, AI909924.1, AV317023.1, AI610452.1, AV272219.1, AA253945.1, D81299.1, AA163258.1,
AW151974.1, AA267651.1, D25843.1, AV362354.1, AA602506.1, N55893.1, T60706.1, AW556255.1, AW542024.1,
AW537016.1, AV289834.1, AV289382.1, AV289178.1, AV288814.1, AV224618.1, AV139922.1, AV137850.1,
AV046737.2, AV035033.1, AV019927.1, AV004214.1, AV004049.1, AI646744.1, AI504196.1, AU045405.1, AI195953.1,
AI194930.1, AI174039.1, AI118360.1, AU018650.1, AU017925.1, C87705.1, C85970.1, AA213332.1, AC026436.2,
AC024518.2, AL355335.2, AC018613.3, AL355821.3, AL356099.1, AC017268.1, AC008225.2, AC008029.2,
AC016938.3, AC023406.2, AC021184.2, AC019498.1, AP001274.1, AC069202.1, AC022081.11, AC008517.4,
AC007383.3, AC022738.3, AC004688.6, AC019213.4, AF215845.1, AC019247.3, AC004709.3, AL121920.11,
AL353748.1
SEQ ID NO: 532
ZH146/T3

NM_002810.1, U24704.1, U51007.1, NM_008951.1, AF013099.1, U72664.1, AB017188.1, NM_015887.1, AF050199.1,
AL163271.2, AP001726.1, AP000695.1, AE003594.1, AF132175.1, S79502.1, AC004682.1, AC007887.8, AL161533.2,
AL0496381, AC024744.1, AC007199.1, M37839.2, AF040660.1, AF028594.1, AL163265.2, AL032623.1, AL080316.8,
AC000124.1, AJ249712.2, Z96104.1, L36818.1, AP001720.1, X76775.1, X87344.1, AB030580.1, L24444.1, AP000169.1,
AP000054.1, AP000326.1, AP000122.1, AW673436.1, AW672767.1, AW673459.1, AA308484.1, AA171439.1, AW248977.1,
AI879204.1, AW249106.1, AA579150.1, AL044248.1, AW673459.1, AA308484.1, AA171439.1, AW659167.1,
AW656822.1, AW655068.1, AA305222.1, AA082806.1, H83202.1, AA204750.1, AA316542.1, AA307459.1,
AW230957.1, AA304882.1, AI014833.1, AA510737.1, AW478534.1, AA869524.1, AA378571.1, AA338888.1,
AA221171.1, AI593123.1, AA500712.1, D31409.1, AA230745.1, AA396511.1, AA351328.1, H24730.1, AW405232.1,
AA792589.1, AA756197.1, AA413708.1, W98705.1, AW407152.1, AA571568.1, AA351224.1, AA237807.1,
AA095807.1, D30928.1, AW298845.1, AA193157.1, W29295.1, C84560.1, AA544200.1, AA212988.1, AW494135.1,
AA450618.1, AA173808.1, AW229742.1, AA004048.1, AA590904.1, AA675428.1, AW238959.1, W05271.1,
AA623538.1, AA623582.1, AW797533.1, AW446745.1, R58821.1, C02139.1, AA537242.1, R74699.1, R74648.1,
Z24793.1, W98493.1, AW280558.1, AW305568.1, AW280521.1, AA222858.1, AI957972.1, AL118454.1, AW233195.1,
AI497266.1, AA352114.1, AA780170.1, AW158597.1, AA982659.1, AI497229.1, AA637331.1, AI980403.1, T30391.1,
R95474.1, AW643627.1, AA617293.1, AA607817.1, W78781.1, AI056400.1, AI090158.1, AA607118.1, AA210395.1,
AA855077.1, AC009564.4, AC000005.1, AC024074.3, AC017581.1, AC009075.5, AC051656.2, AC022632.3,
AC021964.1, AP000408.2, AC020877.2, AC025426.2, AP000758.1, AC016955.9, AC012496.4, AC011086.4,
AC026421.2, AC016629.5, AC011505.3, AC032039.1, AC012063.2, AC023036.1, AC022094.1, AC011286.4,
AC006704.1, AL132640.1, AL031011.20, AP000932.2, AP000844.1, AP000800.1, Z95393.1
SEQ ID NO: 533
ZH147/T3

AL163266.2, AP001721.1, AP000I71.1, AP000057.1, AP000330.1, AP000L25.1, D43969.1, D43968.1, X90976.1,
D26531.1, AF116587.1, AL163229.2, AL117202.1, AP001684.1, AP000959.2, Z97348.1, AL035470.7, AC004747.2,
AE003811.1, AE003548.1, AE003503.1, AE002760.1, AE003194.1, AC006986.2, AC016831.1, AF116027.1,
AE000597.1, AC006313.1, AC006198.1, AF096373.1, AF017104.1, AF034976.1, AC004766.1, AC004629.1, AF044870.1,
AF044869.1, U82375.1, AL161517.2, AL161516.2, AL078463.1,1, Z83236.1, AL096763.14, AL096699.11, Z68134.1,
Z71266.1, AL022313.1, AL079338.15, AL034552.22, AL049488.1, AL04948 1.1, AB006700.1, AJ228191.1, AI798056.1,
W25586.1, AI323622.1, AA125379.1, AW609213.1, AA851955.1, AA210262.1, AI542974.1, N98022.1, AW807912.1,
AW807845.1, AW807823.1, AW807767.1, AW807668.1, AW609186.1, AI813851.1, AW218206.1, AV292256.1,
AW043002.1, AI919833.1, AA956689.1, AA945982.1, AA806582.1, AA610907.1, F12673.1, I74354.1, AC011257.3,
AC021619,3, AC013300.2, AC068863.1, AC026607.2, AC008076.8, Z92854.1, AC069133.1, AC012435.6, AC036214.2,
AC009054.4, AC068374.1, AC058806.1, AC016879.4, AC022248.2, AC024535.2, AC006278.6, AC022620.1,
AC016495.1, AL354894.1, AP001593.1, AC010621.3, AC016323.4, AC026850.2, AC0) 9345.3, AC021385.3,
AC005505.6, AC022888.2, AC022940.1, AC009580.2, AC011149.1, AC005139.3, AC005586.1, AL109844.3,
AL354698.2, AL3 53774.1

TABLE 1-continued

Sequence homologies (GenBank Accession Numbers)

SEQ ID NO: 534
ZH147/T7

AC011257.3, AC021619.3, AC013300.2, AC068863.1, AC026607.2, AC008076.8, Z92854.1, AC069133.1, AC012435.6,
AC036214.2, AC009054.4, AC068374.1, AC058806.1, AC016879.4, AC022248.2, AC024535.2, AC006278.6,
AC022620.1, AC016495.1, AL354894.1, AP001593.1, AC01 0621.3, AC026850.2, AC019345.3,
AC021385.3, AC005505.6, AC022888.2, AC022940.1, AC009580.2, AC011149.1, AC005139.3, AC005586.1,
AL109844.3, AL354698.2, AL353774.1, AW170035.1, AA808812.1, N59527.1, AA225759.1, AA766310.1, AL134398.1,
D57390.1, AI638711.1, AI580781.1, AW043680.1, AA664700.1, F00440.1, AI914872.1, AI821400.1, AL287627.1,
AL287541.1, AL284640.1, AI024030.1, AW872676.1, AW473163.1, AI972203.1, AI817516.1, AI355 556.1, AI085719.1,
AI766275.1, AA330322.1, AI633942.1, AW089625.1, AW071163.1, AA224525.1, AA137274.1, AW600804.1,
AI819574.1, AA737432.1, AA459749.1, AW022897.1, AA810438.1, AW179028.1, AI632259.1, W70188.1, AI963266.1,
AI924251.1, AI791819.1, AA229609.1, AA228418.1, AA228330.1, T41259.1, AA593471.1, AA524821.1, AA128899.1,
W68497.1, W68362.1, AW503631.1, AA815052.1, AA179944.1, N99939.1, AW440545.1, AI004704.1, AA831132.1,
AA630637.1, AA309530.1, AA112239.1, AA015649.1, AW504554.1, AW087945.1, AI821596.1, AI351599.1,
AA593752.1, AA449661.1, AA404541.1, AW138732.1, AW088224.1, AW080062.1, AL037632.3, AW008089.1,
AI952885.1, AI792213.1, AI733504.1, AI004333.1, AA601157.1, AI129968.1, AI038990.1, AI890888.1, AL048969.1,
AI568862.1, AI307372.1, AI014358.1, AA722372.1, AA658844.1, AA290563.1, AI057103.1, AI791664.1, U51702.1,
T70713.1, AW408643.1, AI354862.1, AI313042.1, AA287570.1, AA634830.1, H96249.1, AW170035.1, AA808812.1,
N59527.1, AA225759.1, AA766310.1, AL134398.1, D57390.1, AI638711.1, AI580781.1, AW043680.1, AA664700.1,
F00440.1, AI914872.1, AI821400.1, AL287627.1, AL287541.1, AL284640.1, AI024030.1, AW872676.1, AW473163.1,
AI972203.1, AI817516.1, M355556.1, AI085719.1, AI766275.1, AA330322.1, AI633942.1, AW089625.1, AW071r63.1,
AA224525.1, AA137274.1, AW600804.1, AI819574.1, AA737432.1, AA459749.1, AW022897.1, AA810438.1,
AW179028.1, AI632259.1, W70188.1, AI963266.1, AI924251.1, AI791819.1, AA229609.1, AA228418.1, AA228330.1,
T41259.1, AA593471.1, AA524821.1, AA128899.1, W68497.1, W68362.1, AW503631.1, AA815052.1, AA179944.1,
N99939.1, AW440545.1, AI004704.1, AA831132.1, AA630637.1, AA309530.1, AA112239.1, AA015649.1, AW504554.1,
AW087945.1, AI821596.1, AI351599.1, AA593752.1, AA449661.1, AA404541.1, AW138732.1, AW088224.1,
AW080062.1, AL037632.3, AW008089.1, AI952885.1, AI792213.1, AI733504.1, M004333.1, AA601157.1, AI129968.1,
AI038990.1, AI890888.1, AL048969.1, AI568862.1, AI307372.1, AI014358.1, AA722372.1, AA658844.1, AA290563.1,
AI057103.1, AI791664.1, U51702.1, I70713.1, AW408643.1, AI354862.1, AI313042.1, AA287570.1, AA634830.1,
H96249.1,
SEQ ID NO: 535
ZH167/T3

NM_001722.1, M17754.1, Z97214.1, Z77852.1, AP000495.1, AC006559.6, AF054584.1, M59454.1, AE003619.1,
Z75744.2, AJ000330.1, Z92524.1, AC008860.6, AE003639.1, AE003626.1, NM_013102.1, NM_007361.1, NM_008019.1,
AC010206.8, AC005119.6, AF069772.1, AF121253.1, AC005252.1, U48473.1, AC005186.1, AC005368.1, AC005135.1,
AL080286.16, Z54146.1, AL031656.10, AL035688.8, U65101.1, U65097.1, U20523.1, Z95274.1, X15209.1, X15750.1,
U26425.1, X60203.1, AB009778.1, J05200.1, AK000956.1, D16478.1, AJ223500.1, Y15170.1, D86641.1, D86425.1,
AA190974.1, AI594912.1, AA059622.1, AL040283.1, AA110907.1, W46471.1, AI386232.1, AA122727.1, AA399844.1,
AI326828.1, AI322682.1, AA048220.1, AW003894.1, AW258382.1, AW476686.1, AV399222.1, AW644870.1,
AA834121.1, AA794714.1, AA717337.1, D74157.1, D73725.1, D73628.1, D68884.1, AW823309.1, AW542250.1,
AW532772.1, AW525852.1, AW520311.1, AW435345.1, AW414137.1, AW400941.1, AW253719.1, AW253092.1,
AV289217.1, AV256080.1, AV383396.1, AW111251.1, AW048811.1, AW046486.1, AW044968.1, AI946809.1,
AI945207.1, AI893330.1, AI846539.1, AI836092.1, AI786376.1, AI786350.1, AV098966.1, AI764417.1, AI703598.1,
AV037764.1, AV013891.1, AV007174.1, AV001383.1, AV000652.1, AI648905.1, AI575993.1, AU051376.1,
AA900458.1, AA859712.1, AI324138.1, AI303590.1, AL256542.1, AL240294.1, AI179661.1, AI155734.1, AI123022.1,
AI105423.1, AA800240.1, AA800189.1, AA690461.1, AA608505.1, AA408052.1, AA271498.1, AA241272.1,
AA210454.1, AA161957.1, AA141162.1, AA048258.1, Z46979.1, AC012046.5, AC025669.2, AC013537.2, AC023257.2,
AC069073.2, AC016450.4, AC015686.2, AL354921.1, AL157761.1, AC02,5715.1, AC020617.2, AC015047.1,
AC008185.2, AC006892.2, AC006745.1, AL355531.1, AC044879.2, AC023497.9, AC022508.6, AC036174.2,
AC025444.3, AC022098.5, AC011469.5, AC008947.5, AC008781.4, AC008439.3, AC068039.2, AC027619.2,
AC022454.8, AC018990.4, AC025144.2, AC025872.2, AC015916.3, AC011864.3, AC015854.3, AC010020.5,
AC014147.1, AC020170.1, AC009340.3, AC009744.6, AC010934.2, AC004689.5, AL157836.4, AL356131.2,
AL162497.7, AL121827.11, AL163545.4, AL158068.4, AL118557.1, AL139396.1,
SEQ ID NO: 536
ZH167/T7

NM_001722.1, M17754.1, AC000097.1, AC005664.2, AC006547.9, AC000083.1, NC_001142.1, AC012467.9,
AE003525.1, AC009247.11, AC006441.13, AC004468.1, AF091342.1, AL135978.2, X70810.1, AL023775.1, Z49501.1,
X87611.1, X17191.1, AE003718.1, AC018633.2, AF054589.1, AC004458.1, AC008115.3, AC007459.1, AC007015.1,
AF011889.1, U19874.1, AC005391.1, AC005273.1, AL138996.2, AL110195.1, AL049698.3, AL031123.14, AL023802.1,
Z81030.1, Z68885.1, AL096838.1, AL022150.1, AL117391.1, AJ007747.1, X02732.1, U28153.1, AB032359.1,
AP001l11.1, AB016897.1, M20128.1, K03233.1, AB012132.1, AB011399.1, AB006909.1, AW245980.1, AW476213.1,
AA563702.1, AW003894.1, M148206.1, M199590.1, AI199679.1, AA161400.1, AI499840.1, AA191442.1, AI691087.1,
AA921302.1, AA449191.1, W46389.1, AW087918.1, AI056425.1, AA143049.1, AL245821.1, AI079110.1, AW476686.1,
AW173136.1, AA143248.1, AW087753.1, AA664376.1, AI971276.1, AW780086.1, AL262737.1, AW088799.1, D53315.1,
AI890991.1, AI940628.1, AW062876.1, W46471.1, AI937731.1, AA993377.1, AI919573.1, AA449190.1, AI498580.1,
AW484249.1, AW434617.1, AW32.5394.1, AW314829.1, AA858776.1, AI009362.1, M171406.1, AI105441.1,
AA850668.1, AI600174.1, AW519712.1, AW491400.1, AW489084.1, AI662711.1, AI386232.1, AI326828.1, AI326118.1,
AI322682.1, AA399844.1, AA268312.1, AA048220.1, AI170591.1, AA916521.1, AW610643.1, AI196133.1,
AW824654.1, AW778759.1, AW628131.1, AW518437.1, AW291802.1, AI397742.1, AI910476.1, AI769417.1, F36565.1,
F30370.1, AI565220.1, AI505161.1, AI347259.1, AL271998.1, AL228232.1, AI198686.1, AA992357.1, AA960836.1,
AA926927.1, AA909034.1, AA828329.1, AA827915.1, AA796746.1, AA748774.1, AA587713.1, AA416606.1,
AA389924.1, AA278811.1, D44667.1, N49551.1, N49308.1, N46431.1, R82432.1, AC012046.5, AC025669.2,
AC027311.2, AC016150.5, AC011987.3, AC016263.3, AC019147.3, AC011568.3, AC022573.2, AL157836.4,
AL354698.2, AL161647.5, AL157379.3, AL139340.5, AL355599.2, AL162234.3, AL353757.1, AC010590.4,

TABLE 1-continued

Sequence homologies (GenBank Accession Numbers)

AC008761.3, AC015925.3, AC025316.2, AC022875.2, AC015724.4, AC022234.2, AC018841.2, AC022374.1,
AL133347.6, AC040973.2, AC024189.3, AC027068.2, AC026583.2, AC013337.5, AC023204.1, AC012976.1,
AC068545.2, AC067951.3, AC068660.1, AC011475.5, AC010458.4, AC011461.2, AC026949.2, AC021887.3,
AC020740.4, AC009222.2, AF248716.1, AC021814.2, AC026471.1, AC020565.4, AC023361.3, AC021060.8,
AC007804.5, AL136361.3, AL139255.1
SEQ ID NO: 537
ZH181/T3

AL137532.1, AB029032.1, AE003497.1, AB024035.1, AC002352.1, AJ243957.1, M92280.1, AP000003.1, Z4677321,
AA385836.1, AW270215.1, AU066952.1, AW430391.1, AI615452.1, AA553056.1, AI044242.1, AW339333.1,
AW199112.1, AA818999.1, AI180338.1, AA575239.1, R57867.1, AC022489.3, AP000484.2, AC015416.1, AL355481.2,
AC060830.3, AC026726.3, AC036111.2, AC020549.3, AC031977.3, AC037465.1, AC021320.3, AC027369.1,
AC021037.4, AC021488.3, AC023753.5, AC009923.3, AC018510.3, AC012044.4, AC016532.2, AC011829.2,
AC016499.1, AC002353.1, AL354894.1, AL139399.1, AP002000.1, AP000450.2
SEQ ID NO: 538
ZH181/T7

AB029032.1, AL137532.1, AC003075.1, AF110420.1, AC000110.1, AL031643.1, AC005587.1, AC006227.1, Y09929.1,
Y07645.1, AE003540.1, AC005292.4, U39995.1, AC002996.1, AL136039.2, AL161517.2, Z70312.1, Z11126.1, Z98755.1,
AL049523.1, AB016873.1, AW608977.1, AA478663.1, AI332836.1, AW613209.1, AI690447.1, AI568320.1,
AA130075.1, AW297346.1, AA211783.1, AW337781.1, R61516.1, T23481.1, M860067.1, AI580679.1, AI076751.1,
AA960940.1, R76699.1, D61837.1, AA479203.1, AA029329.1, HI 6598.1, AA250974.1, AI925777.1, AA603423.1,
AL221611.1, T16483.1, D62007.1, R42735.1, T16667.1, R37151.1, AW381386.1, AW020319.1, D62171.1, AW381401.1,
AA724627.1, D59415.1, AW311719.1, AA862732.1, H13558.1, AA862731.1, R23086.1, AI010238.1, AW436334.1,
AI875668.1, AI649360.1, AI504358.1, AJ392892.1, AI790295.1, AI853026.1, AW521101.1, AA924446.1, AA924003.1,
AV368842.1, AW522536.1, AV335603.1, AW824580.1, AW540445.1, AW494950.1, AV338236.1, AV313663.1,
AV271828.1, AV271030.1, AV270109.1, AV259717.1, AV254619.1, AV229042.1, AI800388.1, AI765324.1, AI64.6211.1,
AI645590.1, AI643880.1, AI570172.1, AI451201.1, AI448335.1, AI394853.1, AI368204.1, AA756342.1, AA527645.1,
AA395949.1, AA217324.1, AA198502.1, AA163260.1, AW503085.1, AV339275.1, AU073033.1, AU072942.1,
AI592797.1, AI381371.1, AI345559.1, AL247533.1, AI122002.1, R59960.1, R45176.1, AC022489.3, AC011123.4,
AP001460.2, AP001562.1, AC010470.4, AC024176.4, AC027519.2, AC069127.1, AC027321.2, AC027303.2,
AC012312.4, AC008932.4, AC008534.3, AC027239.2, AC021546.3, AC031999.1, AC011205.3, AC064858.1,
AC036229.1, AC019202.3, AC061986.2, AC018764.4, AC027780.2, AC010142.3, AC021364.3, AC018961.3,
AC024325.2, AC009985.5, AL355980.2, AL139136.3, AL353734.3, AL354955.1, AL162375.4
SEQ ID NO: 539
ZH182/T3

NM_002465.1, X73114.1, X66276.1, U38949.1, D43697.1, NM_005683.1, AF216829.1, AF174036.1, AF174022.1,
AF174013.1, AF096786.1, AF064879.1, AF013626.1, AF013621.1, AF013619.1, AF013616.1, AF062220.1,
AF062207.1 AF062204.1, AF062203.1, AF062201.1, AF062149.1, U57564.1, U86524.1, U86523.1, AL234257.1,
AL234190.1, AJ234189.1, AL234187.1, A3234160.1, S55017.1, U8425.1, U2468&1, U24683.1, Z82892.1, Z82875.1,
X62112.1, Z47221.1, Y08303.1, Z14241.1, Z14240.1, Z14238.1, Z14239.1, Z14237.1, Z14235.1, Z14236.1, Z75396.1,
Z75390.1, Z75388.1, Z75385.1, Z75375.1, Z75372.1, Z75405.1, Z75363.1, AB019439.1, X55344.1, X92222.1, X05715.1,
X05714.1, X92268.1, X92267.1, X92266.1, X92265.1, X92263.1, X92262.1, X92261.1, X92260.1, X92259.1, X92257.1,
X92234.1, X92233.1, X92229.1, X92223.1, X52895.1, X65911.1, X95660.1, Z14196.1, Z14194.1, Z14193.1, M83133.1,
M99607.1, M99601.1, M67500.1, L03677.1, M99683.1, M97921.1, U00922.1, U00923.1, AL049561.16, L43560.1,
AA192597.1, AW106443.1, AW106106.1, AA196576.1, AA196377.1, AA195988.1, AA17684.6,1, AW663328.1,
AW403437.1, AI904059.1, AA715258.1, AA152774.1, AW869888.1, AW403989.1, AW403538.1, AC026615.2,
AF235100.1, AF192304.1, AC016730.4, AC019144.4, AC015501.3, AC068140.1, AC023059.7, AC021286.3,
AC025105.1, AC012507.3, AC013555.2, AL355813.3, AC069007.1, AC010601.3, AC010288.4, AC013293.4,
AC021017.3, AC007674.2, AC027004.2, AC012500.2, AC022836.2, AC012407.2, AL354674.2, AL355833.1,
AL162387.3, AL157770.2, AL121768.1, AP001190.1
SEQ ID NO: 540
ZH182/T7

NM_002465.1, X73114.1, X66276.1, AC010205.5, X90475.1, AL133244.1, AC002485.1, AF077338.1, AF078781.1,
AL121586.28, D49525.1, NM_016749.1, AF132970.1, NM_015963.1, AC003999.1, AP002418.1, AF092341.1,
AL355094.2, AL163231.2, AL161751.2, AL133371.2, AC000119.1, AL109954.12, Z69722.1, AL034425.6, Z97198.1,
Z93242.1, U68267.1, AP001686.1, D63999.1, AK001216.1, AP000949.2, AI871474.1, AW453075.1, AI339458.1,
AI865749.1, P31649.1, P27320.1, N66106.1, H15163.1, AA196378.1, AA046973.1, P00500.1, AA176824.1, P26981.1,
P32864.1, F02786.1, F36775.1, AA257061.1, F10536.1, AA211479.1, AI911209.1, AA923787.1, AA452252.1,
AA425104.1, AA194492.1, AA086270.1, AI039263.1, AA194576.1, AA196577.1, AA192152.1, P19051.2, P27495.1,
P26423.1, F24238.1, AA640428.1, AA640400.1, P22818.1, P22292.1, AA214001.1, AA196860.1, AA196333.1,
AA196001.1, F29262.1, P28900.1, F24330.1, P20624.1, P20593.1, AA193272.1, P28574.1, F31988.1, P28187.1,
P22193.1, F19362.2, F25180.1, AA196116.1, F20802.1, F19022.2,P28853.1, AA779499.1, F01063.1,.AA176573.1,
P23432.1, P20622.1, P29389.1, F20591.1, F01001.1, P34732.1, AA180180.1, P27121.1, AW535343.1, AA410420.1,
AA196071.1, F23360.1, F16754.2, P28536.1, P30693.1, P34053.1, F33541.1, P32489.1, P25734.1, AW107813.1,
P30557.1, P26321.1, AW108242.1, AA410419.1, F30201.1, P29588.1, P32904.1, AA194692.1, AA194700.1, F26643.1,
F20923.1, F23306.1, P32500.1, F32030.1, P26922.1, AI391161.1, AA085911.1, P29539.1, AI171098.1, P24645.1,
AC068865.1, AC022662.4, AC019180.4, AC009591.3, AC016468.2, AC055787.1, AC027141.1, AC016017.6,
AC006741.2, AL139226.14, AP001127.1, AC048343.3, AC025419.6, AC015560.2, AC060779.2, AC009568.4,
AC068748.1, AC032025.2, AC011467.5, AC027132.2, AC027131.2, AC024563.2, AC017023.3, AC019155.3,
AC060813.1, AC037442.1, AC023535.2, AC025745.1, AC022996.2, AC021617.4, AC012657.3, AC023168.6,
AC016335.2, AC017017.3, AC015748.4, AC013276.2, AL355922.1, AL354675.2, AL353634.2, AL157715.2,
AL138878.3, AL139429.4, AP001102.2, AP000811.1

TABLE 1-continued

Sequence homologies (GenBank Accession Numbers)

SEQ ID NO: 541
ZH189/T3

AF039019.1, AJ236885.1, L04282.1, NM_011749.1, X98096.1, U80078.1, U30381.1, AJ001165.1, AC007193.1,
AL009179.1, AC011462.4, AC011465.4, AC004846.2, AC005482.2, AC007748.2, AC007860.6, AC006160.9,
AC004821.2, AC007191.1, AC002996.1, AC004199.1, U78027.1, AL132986.2, AB040889.1, AP001631.1, AC005777.1,
AC004013.1, U95740.1, AC007358.2, AC005084.1, AC005089.2, AC003982.1, AP000190.1, AP00004.6,1, AP000114.1,
AP000013.2, AC016830.5, AC016027.15, AC004128.1, AC005534.2, AC004972.2, AC005954.1, AC005790.1,
AF069291.1, AC004475.1, AL049795.20, AL050318.12, AL022721.1, AC006028.3, AC006064.9, AC004835.2,
AC005821.1, U60902.1, AC005581.1, AL163256.2, AL035681.13, AL035667.12, AP001711.1, AC007731.14,
AC008635.6, AC005500.2, AC006038.2, AC006111.2, AC005015.2, AC005023.1, AC005072.2, AC007536.9,
AC010077.1, AC005520.2, AC007055.3, AC005037.2, AC005844.7, AC005755.1, AC003104.1, AC004560.1,
AC004496.1, AL133415.12, AL133387.8, AL121653.2, AD000864.1, AC000118.1, Z99716.4, Z70288.1, AL118497.9,
AL031186.8, Z80896.2, AL008635.1, Z83845.14, AL031003.1, Z97054.1, Z84814.1, AL034394.2, AL022143.1,
AP001629.1, AP000212.1, AP000134.1, AP000359.1, Z82097.1, AP001434.1, AP000020.2, AL038916.1, AW261045.1,
AI158501.1, AA967471.1, AW498473.1, AW376969.1, AW243787.1, AI869078.1, AI826253.1, AL036595.1,
AL035988.1, AI791354.1, AI732958.1, AI678392.1, AI610840.1, AI379192.1, AI371165.1, AL287867.1, AA928108.1,
AA862344.1, AA703833.1, AA631359.1, AA630961.1, AA629961.1, AA621838.1, AA617939.1, AA587667.1,
AA579765.1, AA553330.1, AA543002.1, AA525157.1, AA521277.1, AA486656.1, AA486559.1, AA226153.1, C05714.1,
H93628.1, R37792.1, AW867156.1, AW833911.1, AW817978.1, AW815409.1, AW572202.1, AL540153.1, AI524366.1,
AI375542.1, AA659083.1, AA626591.1, AA618206.1, AA532611.1, AA350859.1, AA338904.1, AA320139.1,
AA299671.1, AA215929.1, AA152463.1, AA078441.1, N22850.1, H74314.1, P11060.1, F10330.1, AA593516.1,
M039081.1, C14035.1, R74491.1, R2294.6,1, AA804828.1, AA247422.1, AL043144.2, M554910.1, AA953588.1,
AL134531.1, AA732398.1, AL079476.1, AI351839.1, AA864294.1, AA678569.1, AA603835.1, AA457651.1,
AA457650.1, N88725.1, AW405759.1, AA622889.1, AA603315.1, AA443390.1, D29262.1, AW069445.1, AA576736.1,
AA478448.1, AA127385.1, AW265080.1, AI078411.1, AW511210.1, AW087679.1, AA939334.1, AA348891.1,
AA348890.1, AA287856.1, AA825928.1, R93341.1, AC019289.3, AC032043.1, AC026618.1, AC008481.6, AC020561.2,
AC069164.2, AC026110.5, AC048356.2, AC008387.4, AC008538.4, AC040930.2, AC011484.2, AC011466.4,
AC062024.1, AC026077.3, AC022608.2, AC022879.3, AC010732.3, AC010746.3, AC006988.2, AC012021.1,
AL031727.31, AL355339.1, AL157386.3, AL353609.2, AL355097.1, AL159177.3, AP000869.1, AP000714.1,
AC063942.2, AC036224.2, AC027307.3, AC008397.6, AC011511.4, AC009121.5, AC008623.3, AC019360.3,
AC021814.2, AC027252.1, AC025388.2, AC021024.2, AC011137.2, AC015619.1, AC015633.1, AL355593.3,
AL139180.5, AL136233.3, AL354940.3, AL355336.1, Z97199.3, Z97197.3, AL132710.13, AC000383.1, AP001012.2,
AC024100.8, AC023238.4, AC008532.4, AC068322.1, AC011145.3, AC006158.3, AC006156.2, AC040958.1,
AC013564.3, AC018845.3, AC023849.1, AC013577.2, AC007507.2, AC002093.1, AL109844.3, AL157383.2,
AL158075.3, AL160313.2, AP001988.1, AC010827.4, AC011957.2, AC024960.2, AC015612.1, AC024098.7,
AC034303.2, AC068914.1, AC008405.3, AC008467.4, AC036239.3, AC011232.4, AC021301.1, AL355174.3,
AL158034.2, AL162742.4, AL163537.4, AL138685.4, AL354885.1, AL162453.4, AL136173.23, AL023881.23,
AL160176.2, AL122005.2, AP002024.1, AP000478.2, AP000483.3

SEQ ID NO: 542
ZH013/T3

X67877.1, AJ276504.1, AF147264.1, AF086817.1, AL161506.2, AE003593.1, AC007277.2, AE000787.1, U80026.1,
U21689.1, AL352976.2, MO1 0793.1, M24485.1, X08058.1, AC007790.1, AFt 35398.1, AC007386.3, AC002331.1,
AC007980.1, AF083036.1, AC006193.3, AF110771.1, S71364.1, U12472.1, M37105.1, M60279.1, AW732607.1,
AW812332.1, AI929111.1, AW242680.1, AA602867.1, AI906380.1, AW607076.1, AW606846.1, T73537.1, I73517.1,
AW210297.1, AA655773.1, AA068592.1, D77836.1, AA830999.1, AF064940.1, AA138445.1, AA138435.1, AW168245.1,
AV076039.1, AV322722.1, AW143010.1, AJ395456.1, AW760490.1, AW623164.1, AW299088.1, AW270326.1,
AW265219.1, AW160202.1, AI947047.1, AI899991.1, M895054.1, AI811422.1, AI322055.1, AI132845.1, AI124151.1,
AA934299.1, AA934249.1, AA917214.1, AA917118.1, AA736358.1, AA720435.1, AA680599.1, AA680598.1,
AA652507.1, AA635231.1, AA629456.1, AA625037.1, AA618841.1, AA611013.1, AA610986.1, AA210815.1, R84210.1,
T02613.1, AC023196.2, AC017103.3, AC068652.1, AC034206.1, AC013489.3, AC011654.4, AC021987.2, AC010051.4,
AC013201.1, AL158800.1, AP001184.1, AP000668.1, AC068796.3, AC018992.3, AC066689.2, AC024738.2,
AC016575.6, AC008756.4, AC018694.3, AC008073.2, AC011118.4, AC022267.2, AC016885.3, AC016094.4,
AC013449.5, AC011009.4, AC018651.4, AC016128.3, AC016402.1, AL355878.3, AL096828.24, AL109911.22,
AL137851.3, AL354725.1, AL158838.3, AP000754.1, AP001005.1, AP000845.1

SEQ ID NO: 543
ZH013/17

AC004263.1, AL049832.2, AC005940.3, AL049569.13, AL022165.1, AC004814.2, AC002126.1, AC004841.2,
AL163255.2, AL034429.1, AP001710.1, AL049643.12, AF168787.1, D89013.1, AC004655.1, AC004223.1, AC007376.8,
AL110114.1, Z86090.10, AL022237.1, AL135978.2, ALOZI 579.1, AL031984.13, AC005409.1, AC005746.1, AC003070.1,
AL031311.1, AC008101.15, AF053356.1, AC004000.1, AC005189.1, AC006430.22, AC001228.1, AL049692.13,
AC011462.4, AC004480.3, AL163256.2, AP001711.1, AC008635.6, AC004883.2, AC005102.1, AC005067.1,
AC005206.1, AL121751.12, AC005602.1, AL049694.9, AC005I .2, AC005696.1, AC004167.1, AF045555.1, U93305.1,
AL109657.8, Z99716.4, AL031597.7, AC008009.4, AC007954.7, AC011331.1, AC005080.2, AC003071.1, AC004876.2,
AC006449.19, AC005695.1, AC004752.1, AL121601.13, AC008072.3, AC005670.1, AC005067.2, AC005529.7,
AC006059.3, Z98941.1, AJ003147.1, AC006111.2, AC006023.2, AC006930.1, AC006211.1, AC004148.1, AP000704.1,
AC004382.1, A0302996.1, AC006277.1, AL023575.1, AL031431.8, Z98036.1, AC016830.5, AC016027.15, AC004492.1,
AC005391.1, AC007957.35, AC005332.1, AL031284.9, AF225899.1, AL035462.18, AL008734.10, AC005004.3,
AC005793.1, AL121586.28, AC003690.1, AC007919.18, AC003106.1, AC006132.1, AW194386.1, AI079823.1,
AI523316.1, N44678.1, AA436222.1, AI435924.1, AW772322.1, N35306.1, AI697742.1, AI693172.1, AI690121.1,
AA731394.1, AA678737.1, AI766928.1, P35097.1, AI627917.1, AW512196.1, AA833896.1, AA833875.1, AA644090.1,
AA425924.1, AI818362.1, AA456924.1, AW022934.1, AI984168.1, AA158549.1, AA932787.1, AA491767.1, H29914.1,
AA669054.1, AA641122.1, AA084609.1, AW236288.1, AI791659.1, AI192440.1, AA904211.1, F30158.1, AI623764.1,
AI367551.1, AI915081.1, AI133083.1, AA078337.1, AW304580.1, AI653776.1, AI431513.1, AA587516.1, AA523695.1,
AA582746.1, AI687343.1, AI962030.1, AA654781.1, AA452887.1, AW190484.1, AL272649.1, AW512528.1,

TABLE 1-continued

Sequence homologies (GenBank Accession Numbers)

AW338081.1, AI978718.1, AI610737.1, AI565126.1, M371208.1, AA503298.1, AA492105.1, AA405726.1, AA299589.1,
AI187148.1, AA659333.1, AA652834.1, AA251356.1, AI865196.1, AA668147.1, AA290878.1, AW151870.1, AI141130.1,
AI745335.1, AL041894.1, AA368155.1, AW303872.1, AW068853.1, AI961983.1, AI871691.1, AL041815.1, AI687972.1,
AI417469.1, AI192839.1, AI049986.1, AA609834.1, AI654738.1, AI523813.1, N69462.1, AW836352.1, R97713.1,
AW816516.1, AI758858.1, H56035.1, AI748842.1, AI859438.1, AA613624.1, AA827383.1, AA309129.1, AA658853.1,
AC023196.2, AC016824.4, AL355001.3, AC011378.3, AC069198.1, AC007318.3, AC008053.2, AP001385.1,
AP001157.1, AC008745.4, AL109947.5, AL136222.3, AP001192.1, AL139401.3, AC067910.1, AC019073.3,
AC036183.2, AC015982.3, AP001444.1, AC019171.3, AC011212.3, AC011470.4, AC018693.2, AL136332.1,
AC008622.4, AC011247.3, AC010466.1, AC006452.3, AC016701.2, AC016666.2, AL137802.6, AL355149.2,
AC025275.2, AC009152.5, AL033520.15, AL138791.2, AC022243.2, AL137126.4, AL160005.2, AC007637.7,
AC021988.3, AC023973.2, AL121712.22, AP000575.2, AP000944.2, AC010531.3, AC023121.3, AC040160.2,
MZ032035.2, AC016331.2, AC004840.2, AC026513.2, AC026685.1, AL139385.3, AC026164.3, AC024969.2,
AC007924.2, AC011638.3, AC005848.1, AC004586.1, AC008569.5, AC026191.1, AC023470.2, AC025339.1,
AC015795.3, AL354986.1, AL160010.3, AP001177.1, AC010515.5, AC016168.3, AC026361.3, AC023097.2,
AC026130.2, AC011401.5, AC012321.4, AC026856.2, AL136115.6, AL161726.3, AL158830.5, AL132801.1,
AC012310.4, AC007612.2, AC011729.4, AL139022.1, AC008378.5, AC016289.3, AC011326.9, AC008894.4,
AC021194.2, AL355076.1, AC034243.2, AC016611.5, AC018695.3, AC026836.2, AC018391.4, AC008482.4,
AC016542.4, AL138817.5, AC026771.2, AC012651.4
SEQ ID NO: 544
GROUP ZH0515' seq, AW194386.1, AI079823.1, AI523316.1, N44678.1, AA436222.1, AI435924.1, AW772322.1, N35306.1, AI697742.1,
AI693172.1, AI690121.1, AA731394.1, AA678737.1, AI766928.1, F35097.1, M627917.1, AW512196.1, AA833896.1,
AA833875.1, AA644090.1, AA425924.1, AI518362.1, AA456924.1, AW022934.1, AI984168.1, AA158549.1,
AA932787.1, AA491767.1, I429914.1, AA669054.1, AA641122.1, AA084609.1, AW236288.1, M791659.1, AI192440.1,
AA904211.1, P30158.1, AI623764.1, AI367551.1, AI915081.1, AI133083.1, AA078337.1, AW304580.1, AI653776.1,
M431513.1, AA587516.1, AA523695.1, AA582746.1, AI687343.1, AI962030.1, AA654781.1, AA452887.1, AW190484.1,
M272649.1, AW512528.1, AW338081.1, AI978718.1, AI610737.1, AI565126.1, AI371208.1, AA503298.1, AA492105.1,
AA405726.1, AA299589.1, MI 87148.1, AA659333.1, AA652834.1, AA251356.1, AI865196.1, AA668147.1,
AA290878.1, AW151870.1, AI141130.1, AI745335.1, AL041894.1, AA368155.1, AW303872.1, AW068853.1,
AI961983.1, AI871691.1, AL041815.1, AI687972.1, AI417469.1, AI192839.1, AI049986.1, AA609834.1, AI654738.1,
AI523813.1, N69462.1, AW836352.1, R97713.1, AW816516.1, AI758858.1, I156035.1, AI748842.1, AI859438.1,
AA613624.1, AA827383.1, AA309129.1, AA658853.1, AI951118.1, AI880940.1, AI816672.1, AI816636.1, AI816629.1,
AI816628.1, AI816623.1, AI816622.1, AI816621.1, AI816619.1, AI816617.1, AI816615.1, AI816614.1, AI816613.1,
AI816612.1, AI816611.1, AI816609.1, AI816608.1, AI816605.1, AI816601.1, AI815377.1, AI815338.1, AI815337.1,
AI815336.1, AF041408.1, AA249712.1, AA247964.1, AA247827.1, AA096046.1, AA095435.1, N89520.1, N88782.1,
N83229.1, N83168.1, N88601.1, N88018.1, N84855.1, N84781.1, N84048.1, N83992.1, N83991.1, H58760.1, AI816627.1,
AA095359.1, AA093577.1, AA096066.1, AA095641.1, AA092086.1, AW587463.1, AI816673.1, AI816670.1, AI816665.1,
AI816635.1, AI816630.1, AI816625.1, AI816620.1, AI816618.1, AI816616.1, AI816606.1, AI816603.1, AI816354.1,
AI815350.1, AI815348.1, AI815340.1, AW587505.1, AI880936.1, AI816624.1, AI815352.1, AI815334.1, AA096061.1,
N86694.1, N84718.1, N55698.1, AI816680.1, AI816677.1, AI816676.1, AI816634.1, AI815356.1, AI815353.1,
AJ241143.1, AA471338.1, N84830.1, N84712.1, N83993.1, AI816682.1, AI816671.1, AI816666.1, AI816604.1,
AA249353.1, AA093224.1, N89307.1, N87898.1, N84740.1, N55721.1, AI815335.1, AA095511.1, N88518.1, N87989.1,
AI816610.1, AI516674.1, AC067744.2, AL162272.3, AC007351.16, AC010884.4, AC0I5871.1, AC019337.1,
AC015860.2, AL137076.5, AC009401.2, AC027141.1, AC024370.2, AC015720.2, AC015850.1, AC014239.1,
AC009553.1, AC036209.2, AC060754.3, AC061987.1, AC027699.1, AC021187.4, AC013707.2, AC015888.3,
AC010987.4, AC015924.1, AC012248.2, AC013152.1, AL356457.1, AL022284.1
SEQ ID NO: 545
GROUP ZH0513' SEQ AL050302.2, AL163203.2, AL049911.2, NM_014915.1, AB028997.1, Z22786.1, AB011137.2, AL163202.2, AL00g051.1,
AP001464.1, AP000542.1, AC006475.3, AL138654.1, AP000365.1, AP000548.1, AF035938.1, AL132985.2, AP001302.1,
AC004936.2, AC006157.2, AL110120.11, AL078614.2, AC004142.1, AC005284.1, AL079349.2, AL096867.15,
AL035690.10, AP001821.1, AW373574.1, AW170035.1, AW614036.1, AL046701.1, AA759177.1, AW297165.1,
AA521089.1, M78662.1, AA296607.1, P.1920892.1, AI122649.1, AW438556.1, M236531.1, AI180434.1, AI180260.1,
AI176501.1, AA892166.1, AI058351.1, AI044283.1, AA533501.1, AW656081.1, AW656019.1, AW457201.1,
AW247016.1, AI984814.1, AI957948.1, AI904680.1, AL046634.1, AL036452.1, AI786726.1, AI770175.1, AI690374.1,
AI527257.1, AI450726.1, AI446107.1, C87958.1, AA773607.1, AA556007.1, AA398033.1, AA289552.1, AA260439.1,
AA170331.1, AA056391.1, W44909.1, W26464.1, R62950.1, M61978.1, AW574796.1, AW418527.1, AJ281607.1,
AW338178.1, AW331234.1, AW171900.1, AW088936.1, AW052899.1, AI920706.1, AV131385.1,
AI538762.1, M200709.1, AI192436.1, AI154223.1, AI093327.1, AA970354.1, AA631332.1, AA291987.1, N74455.1,
N20326.1, H97559.1, AW373574.1, AW170035.1, AW614036.1, AL046701.1, AA759177.1, AW297165.1, AA521089.1,
M78662.1, AA296607.1, AI951295.1, AI920892.1, AI122649.1, AW438556.1, AL236531.1, AI180434.1, AI180260.1,
AI176501.1, AA892166.1, AI058351.1, AI044283.1, AA533501.1, AW656081.1, AW656019.1, AW457201.1,
AW247016.1, AI984814.1, AI957948.1, AI904680.1, AL046634.1, AL036452.1, AI786726.1, AI770175.1, M690374.1,
AI527257.1, AI450726.1, AI44.6107.1, C87958.1, AA773607.1, AA556007.1, AA398033.1, AA289552.1, AA260439.1,
AA170331.1, AA056391.1, W44909.1, W26464.1, R62950.1, M61978.1, AW662136.1, AL281607.1, AW320227.1,
AW087179.1, M950371.1, AI684965.1, AI368143.1, AI311542.1, AI302518.1, AI192436.1, AI148480.1, AI069596.1,
AI057937.1, AA910838.1, AA856548.1, AA768420.1, AA264497.1, AA708873.1, AA483705.1, AA150449.1,
AA149652.1, AA101607.1, AA071350.1
SEQ ID NO: 546
ZH012/T3

AL157387.1, AL162272.3, AC015940.2, AC008088.2, AC026271.2, AC022596.3, AC036170.2, AC015650.1,
AC023067.3, AL133290.3, AL161912.3, AC021150.5, AC024252.3, AC019078.3, AC0I7099.3, AL139008.8,
AL355472.2, AL161418.4, AL353626.1, AL158083.1, AL137219.1, AL049185.4, AC024107.9, AC068690.1,
AC010248.4, AC027713.2, AC009297.3, AC021009.3, AC010959.3, AC024170.1, AC018844.1, AL157695.2,

TABLE 1-continued

Sequence homologies (GenBank Accession Numbers)

AL138965.3, AI951118.1, AW000914.1, P.1922499.1, AI871874.1, AA991162.1, AA828186.1, AA661357.1, C60377.1,
AA471702.1, AA095151.1, AW659699.1, AW519678.1, AV282871.1, AW029403.1, AI902224.1, AV04575 2.2,
AI311562.1, AU023568.1, AU023063.1, AI075925.1, AA701829.1, AA599836.1, , AC067744.2, AL162272.3,
AC007351.16, AC009401.2, AC027141.1, AC021762.3, AC024370.2, AC014239.1, AC046187.2, AC036209.2,
AC027696.2, AC060754.3, A0061987.1, AC050524.1, AC034685.1, AC026218.2, AC031752.1, AC027699.1,
AC009833.3, AC021187.4, AC017001.4, AC013707.2, AC010705.14, AC021024.2, AC012248.2, AC013152.1,
AL080314.29, AP001455.1, AL022284.1, AC016934.4, AC027748.2, AC036208.2, AC067909.2, AC068541.2,
AC026428.2, AC012631.3, AC008885.3, AC022395.2, AC060232.3, AC013361.4, AC024379.2, AC004932.2,
AC045500.1, AC044804.1, AC024466.3, AC011186.3, AC019207.3, AC009407.3, AC016916.4, AC017083.4,
AC023115.3, AC025596.1, AC023988.2, AC023567.2, AC023399.2, AC016444.2, AC013763.2, AC011296.1,
AC009858.1, AL137863.7, AL356132.3, AL355351.2, AL354884.2, AL161730.3, AL161642.3, AL138683.2
SEQ ID NO: 547
ZH012/T7

U62317.2, AL021939.1, AC005231.2, AC005940.3, AC008039.1, AC007216.2, AF064863.1, AL163283.2, AC007387.3,
AC006312.8, AC006064.9, AC005914.1, U80017.1, AL109976.22, AL031283.26, AL163215.2, AP001670.1, AP000359.1,
AC005004.3, AC005696.1, AC005387.1, AL078638.9, D88270.2, AC008635.6, AC008521.5, AC000353.27, U91321.1,
AC005486.2, AC004967.2, AL121809.4, AL163285.2, Z98742.5, AC011449.6, AC008101.15, AC006285.11,
AC004858.2, AC007240.2, AC006930.1, AC005725.1, AC005899.1, AC004638.1, AL163259.Z AL163255.2,
AL135749.2, AL121603.2, AL121658.2, Z97630.11, AL022165.1, AL033521.2, AP001710.1, AP001714.1, AC007782.20,
AC002377.1, AC004000.1, AC007919.18, AC005280.2, AC005484.2, AC006277.1, AC006130.1, AC005512.1,
AL117186.3, AL049766.14, L78810.1, Z98051.6, AL034400.2, AC008372.6, AC007051.3, AC005971.5, AC004686.1,
AL132712.2, AL049843.18, AC008079.23, AC007324.55, AF196969.1, AC006538.1, AC004771.1, AC005619.1,
AC005209.1, AL109935.39, AL163270.2, AL035587.5, AL031003.2, Z84469.1, AL031311.1, AP001725.1, AP000474.2,
AC008018.20, AC000025.2, AC005011.2, AC004878.2, AC004895.2, AC006544.19, AC005544.1, AC004678.1,
AC002553.1, AC002350.1, U73630.1, AL035422.12, AC005358.1, AC006139.1, AW170035.1, AA588001.1,
AA357669.1, AA502104.1, AW080062.1, AW008089.1, AI9528 85.1, AA323778.1, AA577906.1, AA569631.1,
AA604333.1, AA601355.1, AL048969.1, N49425.1, AW069670.1, AL120269.1, AA224525.1, AW263415.1, M354847.1,
AA634954.1, AA228460.1, AW440545.1, AA584482.1, AW820127.1, AW504011.1, AI679002.1, AA577824.1,
AL138265.1, AL041706.1, AL048626.1, AW600804.1, AI791819.1, AA953588.1, AA679794.1, AA482227.1,
AA228418.1, AA228330.1, AA160658.1, AA806799.1, AA804999.1, AA707833.1, AW504240.1, AI631119.1,
AI354862.1, AA805869.1, AA665449.1, AA613789.1, AA564634.1, AA255626.1, AA209415.1, W64166.1, N80210.1,
1156369.1, M038990.1, AA613954.1, AA584876.1, AA576736.1, AA507657.1, AW406447.1, AW167330.1, AW088224.1,
AL037632.3, AI927170.1, AI580906.1, AA837677.1, AA808796.1, AA714221.1, AA634147.1, AA526787.1, AA516310.1,
AA223932.1, AA113159.1, W96277.1, AL135377.1, AI924251.1, AL243789.1, AI124706.1, AA634991.1, AA443390.1,
AA017377.1, AW630599.1, AA708108.1, AA573496.1, AA459749.1, N99489.1, AW248523.1, AW188427.1, H70699.1,
AW833144.1, AI821596.1, AA643457.1, AA643454.1, AA643452.1, AA348890.1, AA290878.1, AA015649.1,
AW167374.1, AL044340.1, AL289277.1, AA287856.1, AC023151.3, AL161652.5, AC010243.3, AC011498.4,
AC024720.3, AC025336.2, AL354707.6, AP001458.2, AC008736.4, AL133373.1, AC012583.3, AC010311.7,
AC032035.2, AC026472.3, AC020779.3, AC017052.4, AC024100.8, AC012313.5, AC026464.3, AC022159.4,
AC009053.4, AC034193.2, AC027281.2, A3009613.2, AC008378.5, AC009048.5, AC012442.2, AC023038.2,
AL354765.1, AL162415.2, AL139255.1, AC009963.4, AL158207.3, AC008474.6, AC026803.2, AC008749.4,
AC027069.2, AC020978.3, AC022965.2, AL158075.3, AP001885.1, AC015551.9, AC026125.2, AC007430.17,
AC005973.4, AC069024.1, AC022318.3, AC046171.2, AC01 0354.4, AC008610.4, AC010530.3, AC010319.6,
AC025690.3, AC016207.4, AC027272.2, AC016916.4, AC021860.3, AF228728.1, AL139249.2, AL355885.1,
AL355860.1, AL133477.3, AP001201.4, AP001191.1, AC006534.3, AC040173.2, AC011484.2, AC008758.3,
AC020558.3, AC023230.2, AL356385.1, AL158846.2, AL158052.2, AC023047.11, AC053546.3, AC022285.5,
AC024460.2, AC026685.1, AC005845.1, AL121897.24, AL160055.3, AC011464.4, AC007902.2, AC024438.2,
AL353812.6, AL109743.3, AL354980.1, AP001871.1, AC009451.5, AC026936.2, AC022738.3, AC011212.3,
AC006286.13, AL158815.4, AL157931.2, AC018998.4, AC008848.6, AC011200.2, AC008481.6, AP000833.1
SEQ ID NO: 548
ZH015/T3

AL163203.2, AL050302.2, AL049911.2, AP000026.1, AP000025.1, NM_014915.1, AK001137.1, AB028997.1,
AC007617.10, AE003447.1, AJ223186.1, AE003494.1, AC004739.1, AC006355.3, ACJ006045.2, U48386.1, AF044083.1,
AL163233.2, AL163224.2, Z70270.1, Z74696.1, U41993.1, D82813.1, AP001679.1, AP001688.1, AP001506.1,
AP000961.2, AC005522.2, AF246422.1, AC007379.2, AC006478.2, AC004996.1, AC007099.3, AC005100.2,
AC007100.3, AC005879.3, AF076621.1, AC005331.1, AC005177.1, AC004045.1, AL133465.30, AL132766.13,
AL109985.2, AL078644.10, AL022395.2, Z82193.1, Y18930.1, AI951118.1, AW000914.1, AI922499.1, AI871874.1,
AA991162.1, AI604114.1, AI449232.1, AA661357.1, C60377.1, AA471702.1, AA095151.1, AW519678.1, AV282871.1,
AI902224.1, AV045752.2, AI311562.1, AI075925.1, AA828186.1, AA701829.1, AC067744.2, AL162272.3,
AC007351.16, AC009401.2, AC027141.1, AC024370.2, AC014239.1, AC036209.2, AC060754.3, AC061987.1,
AC027699.1, AC021187.4, AC013707.2, AC012542.4, AC012248.2, AC013152.1, AL356457.1, AP001455.1,
AL022284.1, AC2046187.2, AC022418.3, AC008885.3, AC027696.2, AC060232.3, AC004932.2, AC044804.1,
AC019259.3, AC016916.4, AC023988.2, AC023399.2, AC010988.3, AC0I6444.2, AC005139.3, AL356132.3,
AL161730.3
SEQ ID NO: 549
ZH024/T3

AL163203.2, AL050302.2, AL049911.2, AP000026.1, AP000025.1, NM_014915.1, AK001137.1, AB028997.1,
AC007617.10, AE003447.1, AJ223186.1, AC015600.6, AE003617.1, AC004739.1, AC006355.3, AC006045.2, U48386.1,
AF044083.1, Z70270.1, AL163224.2, AJ250841.1, Z74696.1, U41993.1, D82813.1, AP001679.1, AP001506.1,
AP000961.2, AC005522.2, AC007379.2, AC005100.2, AC005479.2, Y18930.1, Z69637.1, AL022395.2, AI951118.1,
AI482625.1, AI487533.1, AW000914.1, AI922499.1, AI902224.1, AI871874.1, AA991162.1, AA736439.1, AA661357.1,
AA660701.1, C60377.1, AA471702.1, AA219203.1, AA095151.1, AW208236.1, AW519678.1, AV322534.1,
AV282871.1, AV382738.1, AI808313.1, AV045752.2, AV043012.2, AI583901.1, AI478844.1, AI311562.1, AI075925.1,
AA828186.1, AA701829.1, AA660895.1, AA660377.1, AC067744.2, AL162272.4, AC009401.2, AC027141.1,

TABLE 1-continued

Sequence homologies (GenBank Accession Numbers)

AC024370.2, AC011254.3, AC012582.3, AC014239.1, AL354836.1, AC062032.2, AC062004.2, AC036209.2,
AC022139.3, AC027699.1, AC012248.2, AL353892.2, AP000872.2, AP001133.1, AC022418.3, AC026295.3,
AC024918.2, AC021149.4, AC022811.1, AC010988.3, AC016444.2, AC005139.3
SEQ ID NO: 550
ZH024/T7

AL033504.3, AC006604.1, AE003524.1, AF016675.2, AC007437.16, AF039039.2, AF047655.1, AC006239.5,
AF10I310.1, AF098500.1, U80023.1, AF068712.1, AC004219.1, Z81567.1, Z78065.1, AF003144.1, AL163241.2,
U50072.1, U40425.1, AP001696.1, AP001597.1, AB015476.1, AC008638.5, AE003639.1, AC002116.1, AC006699.2,
AC005102.16, AC005165.1, AC007297.22, AF039904.1, AC007192.1, AF069076.1, AF077542.1, AF098737.1,
AF098736.1, AF098735.1, AF050665.1, AF099914.1, AC002375.1, AL161548.2, AF014161.1, AF014160.1, AL021710.1,
Z92972.1, Z48543.1, AL121782.9, AL032640.1, AL096800.20, AL163273.2, U80029.1, AL110500.1, U70852.1,
AL096772.5, U50065.1, MI 8370.1, Z80332.1, X06759.1, X06386.1, U15763.1, AP001728.1, AB008822.1, AP001432.1,
M55506.1, AP000151.1, D83253.1, AP000009.2, D90194.1, D90195.1, U14163.1, AA601511.1, AA412108.1,
AL044891.1, AA393080.1, AI913336.1, AI908240.1, AA489119.1, AI681153.1, AI013642.1, AI145328.1, AA894065.1,
AW655882.1, AW654312.1, AW654290.1, AW632141.1, AW481770.1, AW298986.1, AW239842.1, AI594437.1,
AI090825.1, AA597263.1, AA409087.1, AL157387.2, AL162272.4, AC022596.4, AC015818.5, AL356259.1, AL162715.3,
AC026081.2, AC021384.3, AL139327.13, AC034129.2, AC068526.2, AC040905.2, AC027205.2, AC024004.2,
AL356360.1, AL354773.4, AP001996.1, AC044813.3, AC048334.5, AC019230.3, AC011740.2, AC027583.1,
AC011009.4, AC021442.1, AC019577.1, AC006903.1, AC006727.1, AC018917.6, AC068778.4, AC010546.3,
AC009111.4, AC068376.1, AC064876.1, AC025223.4, AC062034.1, AC026043.3, AC025965.2, AC011714.1,
AC009598.2, AC006842.1, AL158089.6, AL137140.5, AL354664.2, AL117348.14, AL031011.20, AL022597.5,
AP001486.1, AP000822.1, AL021450.1, Z95393.1
SEQ ID NO: 551
ZH046/T3

AL163203.2, AL050302.2, AL049911.2, AP000026.1, AP000025.1, NM_014915.1, AK001137.1, AB028997.1,
AC007617.10, AE003447.1, AL223186.1, AE003494.1, AC004739.1, AC006355.3, AC006045.2, U48386.1, AF044083.1,
Z70270.1, AL163224.2, Z74696.1, U41993.1, D82813.1, AP001679.1, AP001506.1, AP000961.2, AC005522.2,
AC007379.2, AC006478.2, AC004996.1, AC007099.3, AC005100.2, AC005879.3, AC005331.1, AC005177.1,
AC004045.1, Y18930.1, AL133465.30, AL132766.13, AL109985.2, AL022395.2, Z82193.1, AI951118.1, AW000914.1,
AI922499.1, AI871874.1, AA991162.1, AU006171.1, AA661357.1, C60377.1, AA471702.1, AA095151.1, AW519678.1,
AV282871.1, AI902224.1, AV045752.2, AI311562.1, AI075925.1, AA828186.1, AA701829.1, AC067744.2, AL162272.4,
AC007351.16, AC009401.2, AC027141.1, AC024370.2, AC014239.1, AC062032.2, AC036209.2, AC060754.3,
AC007131.3, AC061987.1, AC027699.1, AC021187.4, AC013707.2, AC012410.2, AC012542.4, AC012248.2,
AC013152.1, AL022284.1, AC062015.2, AC046187.2, A0022418.3, AC008885.3, AC027696.2, AC060232.3,
AC004932.2, AC024466.3, AC019259.3, AC016916.4, AC023988.2, AC016444.2, AC005139.3, AL161730.3
SEQ ID NO: 552
ZH046/F7

AL050302.2, AL163203.2, AL049911.2, NM_014915.1, AB028997.1, AF090187.1, AL009051.1, AB011137.2,
AL138654.1, AP000365.1, AP000548.1, AC011661.5, AP001302.1, AC004936.2, AC006157.2, Z99291.1, AL031599.1,
U40160.1, AC008526.5, AF156143.1, AC009402.3, AC004142.1, AC009513.2, AC006475.3, AC005760.1, AC005358.1,
AL161595.2, Z11874.1, X70810.1, AL022605.3, U58744.1, X68658.1, X17051.1, AJ002397.1, AW373574.1,
AW170035.1, AA759177.1, AL046701.1, AI957948.1, C87958.1, AW628933.1, AW469178.1, AW338178.1,
AW331138.1, AW320227.1, AW171900.1, AW087179.1, AW052899.1, AW042526.1, AI972424.1, AI950371.1,
AI920706.1, AI784583.1, AU072482.1, AI684965.1, AI460172.1, AI148480.1, AI093327.1, AI025802.1, AA970354.1,
AA708873.1, AA151117.1, AA150449.1, AA149652.1, AA136980.1, AA101607.1, AA071350.1, W73028.1, W35448.1,
H97559.1, H96023.1, AL157387Z AL162272.4, AC022596.4, AC015940.2, AC008088.2, AL354819.2, AL157695.2,
AL138965.3, AC023067.3, AC016739.2, AC025384.2, AL161912.3, AC011983.3, AL137219.1, AL049185.4,
AC040973.2, AC068690.1, AC026427.2, AC020901.5, AC010248.4, AC016684.1, AC026271.3, AC025076.3,
AC051644.2, AC008390.6, AC011434.2, AC026081.2, AC008426.2, AC026395.2, AC016215.4, AC019042.3,
AC009499.2, AC021755.4, AC012174.2, AL356312.1, AL138749.7, AP001541.1
SEQ ID NO: 553
ZH015/T3

AL163203.2, AL050302.2, AL049911.2, AP000026.1, AP000025.1, NM_014915.1, AK001137.1, AB028997.1,
AC007617.10, AE003447.1, AC007639.5, AJ223186.1, AC010340.7, AE003494.1, AC004739.1, AC004886.1,
AC006355.3, AC006045.2, U48386.1, AF044083.1, Z70270.1, AL163233.2, AL163224.2, Z74696.1, U41993.1, D82813.1,
AP001679.1, AP001688.1, AP001506.1, AP000961.2, AC005522.2, AC007379.2, AC006478.2, AC004996.1,
AC007099.3, AC005100.2, AC005879.3, AF116775.1, AC005331.1, AC005177.1, AC004045.1, AL021879.3, Y 18930.1,
AL133465.30, AL132766.13, AL109985.2, AL078644.10, AL022395.2, Z82193.1, AI951118.1, AW000914.1, AI922499.1,
AI871874.1, AA991162.1, AA661357.1, C60377.1, AA471702.1, AA095151.1, AW519678.1, AV282871.1, AW133941.1,
AW010698.1, AI902224.1, AV045752.2, AI311562.1, AI075925.1, AA828186.1, AA701829.1, AC067744.2, AL162272.4,
AC007351.16, AC009105.6, AC009054.4, AC009401.2, AC027141.1, AC024370.2, AC014239.1, AC027783.2,
AC062032.2, AC036209.2, AC060754.3, AC007131.3, AC061987.3, AC027699.1, AC021187.4, AC023567.2,
AC013707.2, AC012410.2 AC012542.4, AC012248.2, AC013152.1, AL022284.1, AC062015.2, AC022418.3,
AC008885.3, AC027696.2, AC060232.3, AC004932.2, AC019259.3, AC016916.4, AC023988.2, AC023399.2,
AC016444.2, AC005139.3, AL161730.3
SEQ ID NO: 554
ZH015/T7

AL050302.2, AL163203.2, AL049911.2, NM_014915.1, AB028997.1, ABO11137.2, AL009051.1, AL138654.1,
AP000365.1, AP000548.1, AC011661.5, AP001302.1, AE003737.1, AC021199.5, AC006157.2, AF090187.1,
AC006557.2, AL021571.1, Z99291.1, AC008526.5, AC009402.3, AC004142.1, AC009513.2, AC006475.3, AC005760.1,
Z11874.1, AL121965.19, X70810.1, AL022605.3, U58744.1, X17051.1, AW373574.1, AW170035.1, AL046701.1,
AA759177.1, AV302770.1, AI957948.1, C87958.1, AW693195.1, AW469178.3, AW335526.1, AW334038.1,

TABLE 1-continued

Sequence homologies (GenBank Accession Numbers)

AW333464.1, AW333047.1, AW332908.1, AW332488.1, AW331138.1, AW320227.1, AW171900.1, AW087179.1,
AW052899.1, AW042526.1, AI972424.1, AI950371.1, AI920706.1, AI784583.1, AU072482.1, AI684965.1, AI593873.1,
AI460172.1, AI148480.1, AI093327.1, AI025802.1, AA970354.1, AA708873.1, AA657017.1, AA230060.1, AA151117.1,
AA150449.1, AA149652.1, AA136980.1, AA101607.1, AA071350.1, W73028.1, H97559.1, H96023.1, AL157387.2,
AL162272.4, AC022596.4, AC015940.2, AC008088.2, AL354819.2, AL157695.2, AL138965.3, AC026271.3,
AC023067.3, AC025384.2, AC011983.3, AL137219.1, AL049185.4, AC026427.2, AC010248.4, AC016684.1,
AC025076.3, AC022507.12, AC008390.6, AC026081.2, AC013362.4, AC025355.2, AC016215.4, AC019042.3,
AC021755.4, AC020749.2, AC023366.2, AC012174.2, AC019249.3, AC007645.3, AL354933.2, AL356312.1,
AL161912.3, AU62251.3
SEQ ID NO555
ZH082/T3

AL050302.2, AL163203.2, AL049911.2, NM_014915.1, AB028997.1, AB011137.2, AL009051.1, AL138654.1,
AP000365.1, AP000548.1, AF132960.1, NM_015954.1, AC022073.13, AE003737.1, AC004936.2, AC006157.2,
Z99291.1, U40160.1, AC008526.5, AC008912.4, AC009513.2, AE001733.1, AC006475.3, AC005760.1, AC005358.1,
AC004646.1, AL161595.2, AL022605.3, U58744.1, AW373574.1, AW170035.1, AA759177.1, AL04.6701.1, AA663940.1,
AW591494.1, AW298804.1, AW236267.1, AW044611.1, AW027676.1, AI970722.1, AI95 7948.1, M829478.1,
M804380.1, AI741971.1, AI719929.1, AI707567.1, AI699017.1, AI611772.1, AI474518.1, M422776.1, AI417636.1,
AI383290.1, AI375177.1, AI370228.1, AI364071.1, AI362738.1, AI355919.1, AI355185.1, AI339716.1, AL281540.1,
AL280241.1, AL274583.1, AI167768.1, AI096951.1, AI085092.1, AA974155.1, AA887695.1, AA866156.1, AA854736.1,
C87958.1, AA831564.1, AA723565.1, AA714063.1, AA649041.1, AA642218.1, AA576795.1, AA525504.1, AA468847.1,
AA449351.1, AA243685.1, AA173664.1, AA171684.1, C00125.1, N74602.1, R94195.1, R89587.1, AW469178.1,
AW338178.1, AW333138.1, AW320227.1, AW171900.1, AW087179.1, AW052899.1, AW042526.1, AI972424.1,
AI950371.1, AI928717.1, AI920706.1, AI784583.1, AU072482.1, AI684965.1, AI460172.1, M148480.1, AI093327.1,
AI025802.1, AA970354.1, AA947120.1, AA708873.1, AA504469.1, AA151117.1, AA150449.1, AA149652.1,
AA136980.1, AA101607.1, AA071350.1, W73028.1, H97559.1, H96023.1, AL157387.2, AL162272.4, AC022596.4,
AC015940.2, A0008088.2, AL354819.2, AL157695.2, AL138965.3, AC021219.2, AL353575.3, AL353136.3,
AC023067.3, A0025384.2, AL161912.3, AC026271.3, AL137219.1, AC068690.1, AC026427.2, AC020901.5,
AC027253.1, AC022080.5, AC019255.2, AC017801.1, AC016684.1, AC022124.3, AC012604.3, AC027625.2,
AC034168.2, AC016215.4, AC021755.4, AC009586.3, AC011286.4, AC009881.3, AL135903.2, AP001284.1
SEQ ID NO: 556
ZH082/T7

AC004527.2, AL163204.2, AP001466.1, AL078614.2, AL355072.2, AL023877.1, AC007501.2, AC003682.1,
AC006032.2, AC004650.1, Z93384.1, Z72505.1, AL161580.2, AL021811.1, AC001228.1, U51281.1, AC024844.1,
AF007544.1, AC004659.1, Z68217.1, AL163237.2, U41019.1, AP001692.1, AE003837.1, AC004605.1, Z78416.1,
AL132943.2, AL132777.2, T95599.1, AU070040.1, AA140870.1, T62163.1, AA648760.1, AW674307.1, AW664490.1,
AW334871.1, AW332410.1, AW331901.1, AV383655.1, AI829650.1, AI743111.1, AI697058.1, AI570895.1, AI570177.1,
AI498194.1, AI453419.1, AI368890.1, AL264827.1, AL220282.1, AL219432.1, AA878714.1, AA777557.1, AA772182.1,
AA765215.1, AA745684.1, AA722275.1, AA720970.1, AA662367.1, AA593706.1, AA526463.1, AA525457.1,
AA525257.1, AA447296.1, AA424313.1, AA404343.1, AA227150.1, AA149254.1, W61377.1, W23934.1, N94485.1,
AW829301.1, AW646575.1, AW640539.1, AW516477.1, AW309883.1, AW139182.1, AI309747.1, AI301308.1,
AL264756.1, AI088990.1, AI018656.1, AA830992.1, AA740946.1, AA703326.1, AA387253.1 AA074666.1, AL157387.2,
AC027800.2, AP001004.2, AC022028.2, AC023528.3, AC024170.1, AL137244.14, AC010738.3, AC009406.3,
AC015808.3, AC015945.3, AP001025.2, AC064867.1, AC011962.2, AC010832.3, AC022572.3, AC022551.3,
AL157368.2, AC024583.3, AC067949.1, AC021029.3, AC007222.1, AL356137.2, AL163540.3, AL162395.2,
AL137218.1, AU 62272.4, AL138812.2, AL353620.1, AC021078.2, AC008818.4, AC011274.3, AC021738.2,
AC009569.2, Z93245.1, AC011302.2, AC016720.4, AL139278.2, AC036237.4, AC009583.3, AC022952.3, AC006281.6,
AC016466.3, AC021668.1, AL139008.8, AL137066.5, AL161629.2, Z95311.10, AC018922.8, AC018920.5, AC039057.3,
AC020672.3, AC007670.2, AC013772.3, AC021801.1
SEQ ID NO: 557
ZH1336/T3

AL163203.2, AL050302.2, AL049911.2, AC004802.1, AC002412.1, D88270.2, AC005856.1, U63630.1, AL035659.22,
AL008635.1, AC016678.4, AC004019.20, AC024076.4, AC012078.3, AC009415.2, AC010072.5, AC005775.1,
AC002400.1, AC000355.1, AF111170.3, AF225900.1, AF225899.1, AC005250.1, AC004008.1, AF176815.1,
AC006014.2, AC006019.2, AC007274.2, AC007877.3, AC006368.2, AC007387.3, AC009516.19, AC002307.1,
AC007214.13, AC007919.18, AC004814.2, AC007237.3, AC005089.2, AC007308.13, AC005488.2, AF134726.1,
AC006241.1, AC006274.1, AC006130.1, AC004047.1, AC005722.1, L78833.1, AC004055.1, AC005523.1, AC005493.1,
AC003682.1, AC004754.1, AC004449.1, AC004030.1, AC002558.1, AC002037.1, AL049759.10, AL035079.14,
AL022163.1, AL021393.1, AL009051.1, AL023494.12, AL031602.14, AL163226.2, AL163222.2, AL160237.2,
AL135940.11, AL137918.2, AL133238.2, AL035072.16, AL121601.13, AL034547.11, Z97630.11, Z68162.1, Z83001.1,
Z99128.1, AL035604.15, Z84718.2, AL031657.2, AL009029.1, Z86061.1, AL033525.10, Z69706.1, Z69918.1, D87675.1,
D00591.1, AP001677.1, AP000365.1, AP000502.1, AP000957.2, AP000964.2, AP000307.1, AP000351.3,
AP000548.1, AP000088.1, AC006581.16, AC005369.1 AL035695.17, AC006157.2, AW170035.1, AI375710.1,
AA100715.1, N76504.1, AW812789.1, AW577142.1, AW026629.1, AL291588.1, AA601355.1, N98802.1, N78038.1,
R92359.1, AW840742.1, AW627425.1, AW517377.1, AW503014.1, AW500125.1, AW298643.1, AW193265.1,
AW103981.1, AW050726.1, AI990487.1, AI978583.1, AI950451.1, AI937125.1, AI907878.1, AL036070.1, AI801591.1,
AI754658.1, AI687343.1, AI311927.1, M133164.1, AA992337.1, AA834843.1, AA458863.1, AA362698.1, AA338904.1,
AA314877.1, AI580781.1, AI168185.1, AI129968.1, AA788990.1, AA503577.1, AI823736.1, AI126468.1, AA621278.1,
AA514328.1, W56548.1, H89487.1, AW298006.1, AI374954.1, AA639250.1, AA635049.1, AA192366.1, W27027.1,
R07361.1, AW504900.1, AI870531.1, AL046701.1, AL043718.1, AI797903.1, AA339361.1, AW197070.1, AJ652536.1,
AL268666.1, AI126656.1, AA644357.1, AA280749.1, AA157017.1, AA031654.1, T23989.1, AI554395.1, AA989349.1,
AA877743.1, AA831132.1, AA506458.1, AA447099.1, AW081941.1, AI808248.1, AA828419.1, AA487368.1, H39920.1,
R72342.1, AW274289.1, AW005902.1, AI962478.1, AI351528.1, AI348589.1, AI198588.1, AI085314.1, AA947454.1,
AA866064.1, AA832188.1, AA433996.1, AA284871.1, N52189.1, H47518.1, AW271235.1, AL042073.1, AL244503.1,
AL157387.2, AL162272.4, AC036208.2, AC023766.2, AC037459.1, AC021108.3, AC015559.1, AL157764.2,

TABLE 1-continued

Sequence homologies (GenBank Accession Numbers)

AC012300.2, AL353998.3, AL162261.2, AC067955.4, AC058791.2, AC020636.4, AC021103.6, AC060822.2,
AC068889.4, AC020604.4, AC067948.3, AC061970.2, AC060764.2, AC044836.2, AC025643.3, AC006534.3,
AC068720.1, AC021193.3, AC016739.2, AC034204.3, AC020900.3, AC011501.5, AC011452.5, AC008622.4,
AC008403.5, AC008392.5, AC010354.4, AC010453.3, AC008839.4, AC032035.2, AC011511.4, AC022954.3,
AC068034.1, AC067979.1, AC012439.4, AC026929.2, AC066599.1, AC063976.1, AC022311.4, AC009701.3,
AC026839.2, AC023134.4, AC021674.3, AC023437.2, AC015992.3, AC015972.3, AC027119.2, AC025956.2,
AC011473.3, AC023924.2, AC012118.2, AC025372.2, AC025371.2, AC022795.3, AC013331.4, AC024322.2,
AC022489.3, AC021132.4, AC017063.5, AC023069.2, AC021287.4, AC010720.2, AC019238.2, AC023287.3,
AC012356.3, AC009963.4, AC021922.1, AC009878.3, AC018408.1, AC018431.1, AC013560.2, AL355517.3,
AL353648.4, AL049537.36, AL356354.1, AL139010.6, AL355586.4, AL355864.2, AL354683.2, AL353791.2,
AL159152.6, AL355132.3, AL355922.1, AL138681.4, AL354867.1, AL161788.4, Z82207.1, AP001405.1, AP000729.1,
AL356218.1, AC017099.3, AL356585.1,
SEQ ID NO: 558
ZH1363/T3

AL050302.2, AL163203.2, AL049911.2, NM_014915.1, AB028997.1, AB011137.2, AL163202.2, AP001464.1,
AP000542.1, AL031116.1, AL009051.1, AC007094.3, AC007970.3, AC018760.4, NM_003299.1, AC004936.2, U40939.1,
AL161957.1, AL110120.11, AL078614.2, L42522.1, AP001465.1, X15187.1, AK000712.1, AC003096.2, AL133475.14,
AL035690.10, AL035446.4, X03704.1, AW373574.1, AW614036.1, AW297165.1, AA521089.1, AA296607.1,
AI988938.1, AI920892.1, AL236531.1, AI180434.1, AI180260.1, AI176501.1, AA892166.1, AI058351.1, AI044283.1,
AA533501.1, AW656081.1, AW656019.1, AW247016.1, AI984814.1, AI904680.1, AL046634.1, AL036452.1,
AI770175.1, AI690374.1, AI446107.1, AA773607.1, AA398033.1, AA056391.1, W44909.1, W26464.1, R62950.1,
M61978.1, AW662136.1, AW614443.1, AW613150.1, AW574899.1, AW574796.1, AW418540.1, AW418527.1,
AW410433.1, AL281607.1, AW320227.1, AW275258.1, AW244097.1, AV271334.1, AW088936.1, AW072295.1,
AW005236.1, AI983391.1, AI924665.1, AV131385.1, AV081079.1, AI538762.1, AI368143.1, AI311542.1, AI302518.1,
AL289573.1, AL200709.1, AI192436.1, AI069596.1, AI057937.1, AI008640.1, AA910838.1, AA856548.1, AA853969.1,
AA768420.1, AA694241.1, AA631332.1, AA581648.1, AA483705.1, AA477329.1, AA404339.1, AA291987.1,
AA071554.1, N74455.1, N20326.1, F04615.1, Z33598.1, AL157387.1, AL162272.3, AC015940.2, AC008088.2,
AC026271.2, AC022596.3, AC036170.2, AC015650.1, AC012256.2, AL133290.3, AC021150.5, AC024252.3,
AL353626.1, AC023568.2, AC027253.1, AC009921.4, AC021821.3, AC024170.1, AC022080.5, AL354896.2,
AL139091.2, AL138770.2, AL138774.2, AC026029.3, AC023416.3, AC021077.3, AC027625.2, AC027493.2,
AC009616.3, AC026081.2, AC025020.2, AC021488.3, AC023977.2, AC012655.4, AC012174.2, AL356259.1,
AL121946.14, AL354819.2, AL157695.2, AL009030.9, AL138965.3, AP001534.1, AP001234.1
SEQ ID NO: 559
ZH137/T3

AL163203.2, AL050302.2, AL049911.2, AP000026.1, AP000025.1, NM_014915.1, AK001137.1, AB028997.1,
AC007617.10, AC006362.2, AE003447.1, AJ223186.1, AC004739.1, AC006355.3, AC006045.2, U48386.1, AF044083.1,
AL163224.2, Z70270.1, Z74696.1, AJ001299.1, U41993.1, D82813.1, AP001679.1, AP001506.1, AP000961.2,
AC005522.2, A0007379.2, AC002528.1, AC006478.2, AC004996.1, AC007099.3, AC005100.2, AC005879.3,
AF121898.1, A0005177.1, AC004045.1, AL031586.2, AL022395.2, Z82193.1, Y18930.1, AB025629.1, AI951118.1,
AA828186.1, AW000914.1, AI922499.1, M871874.1, AA991162.1, AA661357.1, C60377.1, AA471702.1, AA095151.1,
AW519678.1, AW450572.1, AV282871.1, AI902224.1, AI781848.1, AV045752.2, AI311562.1, AI075925.1, AA804372.1,
AA701829.1, T49498.1, AC067744.2, AL162272.3, AC021762.3, AC024370.2, AC009401.2, AC027141.1, AC014239.1,
AC036209.2, AC060754.3, AC007131.3, AC061987.1, AC027699.1, AC021187.4, AC013707.2, AC012410.2,
AC012542.4, AC012248.2, AC013152.1, AL022284.1, AC027311.2, AC022418.3, AC008885.3, AC027696.2,
AC060232.3, AC004932.2, AC044804.1, AC024466.3, AC019259.3, AC006281.6, AC023988.2, AC023399.2,
AC016444.2, AC005139.3, AL161730.3
SEQ ID NO: 560
ZH1610/T3

AL163203.2, AL050302.2, AL049911.2, AP000026.1, AP000025.1, NM_014915.1, AK001137.1, AB028997.1,
AC007617.10, AE003447.1, AL223186.1, AE003494.1, AC004739.1, AC006355.3, AC006045.2, U48386.1, AF044083.1,
AL163233.2, AL163224.2, Z70270.1, Z74696.1, U41993.1, D82813.1, AP001679.1, AP001688.1, AP001506.1,
AP000961.2, D37811.1, AC005522.2, AC007379.2, AC002382.1, AC006478.2, AC004996.1, AC007099.3, AC005100.2,
AC007100.3, AC005879.3, AC009743.1, AC006253.4, AC005331.1, AC005177.1, AC004045.1, AL133465.30,
AL132766.13, AL109985.2, AL078644.10, AL022395.2, Z82193.1, Y18930.1, AI951118.1, AW000914.1, AI922499.1,
AI871874.1, AA991162.1, AA661357.1, C60377.1, AA471702.1, AA095151.1, AW814367.1, AW519678.1, AV282871.1,
AI902224.1, AV045752.2, AI311562.1, AI075925.1, AA828186.1, AA701829.1, AC067744.2, 4L16/T72.3,
AC007351.16, AC009401.2, AC027141.1, AC024370.2, AC014239.1, AC060801.2, AC036209.2, AC060754.3,
AC061987.1, AC027699.1, AC021187.4, AC013707.2, AC010705.14, AC012410.2, AC012542.4, AC012248.2,
AC013152.1, AL022284.1, AC036208.2, AC022418.3, AC012631.3, AC008885.3, AC022486.3, AC027696.2,
AC022395.2, AC060232.3, AC004932.2, AC053528.1, AC044804.1, AC024429.2, AC016916.4, AC023988.2,
AC023567.2, AC013320.4, AC016444.2, AC011296.1, AL137863.7, AL355351.2, AL355587.3, AL354884.2,
AL161730.3, AL158219.2
SEQ ID NO: 561
ZH171/T3

AL050302.2, AL163203.2, AL049911.2, NM_014915.1, AB028997.1, AB011137.2, AL031116.1, AL009051.1,
AC007094.3, AC018760.4, NM_003299.1, U40939.1, AL161957.1, AL110120.11, AL078614.2, I42522.1, AP001465.1,
X15187.1, AK000712.1, AC003096.2, AC007970.3, AL133475.14, AL035690.10, X03704.1, AW373574.1, AW614036.1,
AI920892.1, AL236531.1, AI180434.1, AI180260.1, AI176501.1, AA892166.1, AI058351.1, AI044283.1, AA533501.1,
AW656081.1, AW656019.1, AW247016.1, AI984814.1, AI904680.1, AL046634.1, AL036452.1, AI770175.1, AI690374.1,
AI446107.1, C87958.1, AA773607.1, AA398033.1, AA056391.1, W44909.1, W26464.1, R62950.1, M61978.1,
AW614443.1, AW613150.1, AW574899.1, AW574796.1, AW469178.1, AW418540.1, AW418527.1, AW412062.1,
AW410433.1, AJ281607.1, AW338178.1, AW320227.1, AW244097.1, AV271334.1, AW088936.1, AW087179.1,
AW072295.1, AW005236.1, AI983391.1, AI972424.1, AI950371.1, AI924665.1, AI784583.1, AV131385.1, AI684965.1,

TABLE 1-continued

Sequence homologies (GenBank Accession Numbers)

M538762.1, AI460172.1, AI368143.1, AI311542.1, AI302518.1, AL289573.1, AI192436.1, AI093327.1, AI069596.1,
AI057937.1, AI025802.1, AI008640.1, AA970354.1, AA910838.1, AA856548.1, AA853969.1, AA768420.1, AA631332.1,
AA581648.1, AA483705.1, AA404339.1, AA168585.1, AA151117.1, AA150449.1, AA149652.1, AA136980.1,
AA101607.1, W73028.1, N74455.1, N20326.1, H97559.1, H96023.1, AL157387.1, AL162272.3, AC015940.2,
AC008088.2, AC026271.2, AC022596.3, AC015650.1, AC012256.2, AC023067.3, AL133290.3, AL161912.3,
AC023556.1, AL354819.2, AL157695.2, AL138965.3, AC023568.2, AC027253.1, AC009921.4, AC021821.3,
AC024170.1, AC022080.5, AC010563.3, AL139091.2, AL138770.2, AL138774.2, AL133322.3, AC023416.3,
AC027493.2, AC009616.3, AC021384.3, AC025020.2, AC021488.3, AC021379.3, AC021617.4, AC023977.2,
AC012655.4, AC012174.2, AL356259.1, AL009030.9, AP001234.1
SEQ ID NO: 562
ZH193/T3

AC002497.1, AC006360.2, AC005323.1, AC008123.9, AL163242.2, Z70232.1, AP001697.1, AP001600.1, AP001599.1,
AC007312.1, AC007938.1, AF235098.1, AC003084.1, AF126403.2, AC005874.3, AF134471.1, AC005971.5,
AC006600.4, AC005823.1, AF024496.1, AC002525.1, AL022162.1, X79283.1, AC007349.1, AFt 17341.1, AC008757.5,
AF208389.1, AF205586.1, AC002044.1, AC002530.1, AC006364.3, AC005820.1, AC007488.15, AF118865.1,
AP118859.1, AC007436.1, AP118864.1, AP118863.1, AFt 18861.1, AC006522.5, AC000015.2, AC004816.1,
AC006256.1, AC005669.1, AL136452.7, AL023856.1, AL008721.1, Z99916.1, Z81479.1, AL034416.1, AL031733.3,
AL022398.1, AL008634.1, AL030995.1, AL111626.1, U58755.1, AP000815.1, AW797580.1, M473891.1, AA368397.1,
AA306548.1, AC034129.2, AC040905.2, AC026033.3, AC013336.7, AP001813.1, AP001354.1, AC067739.3,
AC023891.7, AC015970.4, AC044856.2, AC034233.3, AC026434.2, AC016599.3, AC008566.3, AC016173.2,
AC067715.1, AC027098.2, AC026858.2, AC016250.3, AC016039.3, AC025683.2, AC025361.2, AC011686.3,
AC016916.4, AC025207.2, AC012513.4, AC011245.3, AC015721.2, AC010936.2, AC016010.1, AC010733.1,
AL355586.4, AL354820.3, AL136138.1, AP002010.1, AP001834.1, AP0015011, AC012041.8, AC066613.2, AC009148.6,
AC068045.1, AC067795.1, AC019140.3, AC010139.3, AC044789.1, AC026975.2, AC020779.3, AC021880.2,
AC016721.4, AC020755.2, AC021708.2, AC024159.1, AC022612.1, AP188028.1, AL136124.8, AL135786.8,
AL162452.3, AL139122.3, AL138708.2, AC048378.2, AC025178.3, AC022444.3, AC068557.1, AC067850.1,
AC034149.2, AC037196.1, AC022778.3, AC024030.2, AC016441.4, AC023453.1, AL139231.4, AL356459.1,
AL139248.3, AL138724.2, AL136106.2, AP001536.1
SEQ ID NO: 563
ZH193/T7

AL050302.2, AL163203.2, AL049911.2, NM_014915.1, AB028997.1, AB011137.2, AF090187.1, AL009051.1,
AL138654.1, AP000365.1, AP000548.1, AC011661.5, AF035938.1, AP001302.1, AC004936.2, AC006157.2, U40160.1,
AC009402.3, AC004142.1, AC009513.2, X17051.1, AW373574.1, AW170035.1, AL046701.1, AA759177.1, AI957948.1,
C87958.1, T38511.1, AW628933.1, AW469178.1, AW338178.1, AW331138.1, AW320227.1, AW171900.1, AW087179.1,
AW052899.1, AW042526.1, AI972424.1, AI950371.1, AI920706.1, AI784583.1, AU072482.1, AI684965.1, M486778.1,
AI460172.1, AI148480.1, M093327.1, AI025802.1, AA970354.1, AA708873.1, AA151117.1, AA150449.1, AA149652.1,
AA136980.1, AA101607.1, AA071350.1, W73028.1, W35448.1, H97559.1, I196035.1, AL157387.1, AL162272.3,
AC015940.2, AC022596.3, AC008088.2, AC040973.2, AC023067.3, AC016739.2, AC026271.2, AC025384.2,
AL161912.3, AL137219.1, AL049185.4, AC068690.1, AC011211.3, AC015737.4, AC019255.2, AC013414.2,
AL158074.5, AL157695.2, AL138965.3, A0008390.6, AC023337.3, AC034160.3, AC026081.2, AC025355.2,
AC016215.4, AC019042.3, AC021755.4, AC011286.4, AL356312.1
SEQ ID NO: 564
Group ZH139

AL163203.2, AL050302.2, AP000026.1, AP000025.1, AL049911.2, NM_014915.1, AK001137.1, AB028997.1,
AC007617.10, AE003447.1, AE003494.1, AC007028.3, AC002433.1, AC004739.1, AC006355.3, AC009513.2,
AC004902.2, AC006045.2, U48386.1, AP027390.1, AF044083.1, AL163254.2, AL163233.2, AL163224.2, Z70270.1,
Z74696.1, U41993.1, D82813.1, AP001679.1, AP001709.1, AP001688.1, AP001506.1, AP000961.2, AP000205.1,
AP000245.1, AP000127.1, AC005522.2, AC007379.2, AE003064.1, AC004506.1, AC002382.1, AC004823.1,
AC006478.2, AC004996.1, AC007099.3, AC005100.2, AC007100.3, AC005879.3, AC009743.1, AC006253.4,
AC005331.1, AC005177.1, AC004045.1, AL133465.30, AL163912.1, AL132766.13, AL109985.2, AL096816.12,
AL078644.10, Z81103.1, Z81562.1, AL022395.2, Z82193.1, Y18930.1, D64003.1, M17109.1, AI951118.1, AW000914.1,
AI922499.1, AI871874.1, AA991162.1, AU045123.1, AU021965.1, AU021770.1, C87414.1, C85160.1, AA667026.1,
AA661357.1, C60377.1, AA471702.1, AA095151.1, AW519678.1, AV282871.1, AI902224.1, AV045752.2, AI314885.1,
AI311562.1, AI075925.1, AA828186.1, AA812289.1, AA701829.1, AA429403.1, AA426874.1, AA389848.1,
AC067744.2, AL162272.3, AC007351.16, AC021721.3, AC013272.2, AC009401.2, AC018892,2, AC027141.1,
AC024370.2, AC017099.3, AC0f1175.1, AC014239.1, AC036220.2, AC036209.2, AC009143.4, AC009123.5,
AC027728.2, AC027530.2, AC060754.3, AC062032.1, AC007131.3, AC061987.1, AC019064.3, AC027699.1,
AC009833.3, AC016080.3, AC022264.2, AC021187.4, AC013707.2, AC010705.14, AC020617.2, AC012593.3,
AC012410.2, AC012542.4, AC012248.2, AC013152.1, AL139332.3, AP001455.1, AL022284.1
SEQ ID NO: 565
ZH139/T3

AL163203.2, AL050302.2, AL049911.2, AP000026.1, AP000025.1, NM_014915.1, AK001137.1, AB028997.1,
AC007617.10, AE003447.1, AE003494.1, AC007028.3, AC002433.1, AC004739.1, AC006355.3, AC009513.2,
AC004902.2, AC006045.2, U48386.1, AF044083.1, AL163254.2, AL163233.2, AL163224.2, Z70270.1, Z74696.1,
U41993.1, D82813.1, AP001679.1, AP001709.1, AP001688.1, AP001506.1, AP000961.2, AP000205.1, AP000245.1,
AP000127.1, AC005522.2, AC007379.2, AE003429.1, AC004506.1, AC004823.1, AC006478.2, AC004996.1,
AC007099.3, AC005100.2, AC007100.3, AC005879.3, AC005331.1, AC005177.1, AC004045.1, AL133465.30,
AL163912.1, AL132766.13, AL109985.2, AL096816.12, AL078644.10, Z51103.1, AL022395.2, Z82193.1, Y18930.1,
D64003.1, M17109.1, AI951118.1, AW000914.1, AI922499.1, AI871874.1, AA991162.1, AA661357.1, C60377.1,
AA471702.1, AA095151.1, AW519678.1, AV282871.1, AI949555.1, AI902224.1, AV045752.2, AI311562.1, AI075925.1,
AA828186.1, AA701829.1, AA429403.1, AA389848.1, W00819.1, AC067744.2, AL162272.3, AC007351.16,
AC009401.2, AC018892.2, AC027141.1, AC024370.2, AC017099.3, AC022175.1, AC014239.1, AC036220.Z
AC036209.2, AC027728.2, AC027530.2, AC060754.3, AC062032.1, AC007131.3, AC061987.1, AC019064.3,

TABLE 1-continued

Sequence homologies (GenBank Accession Numbers)

AC027699.1, AC009833.3, AC022264.2, AC013707.2, AC020617.2, AC012593.3, AC012410.2, AC012248.2,
AC013152.1, AP001455.1, AC04.6133.3, AC046187.2, AC008885.3, AC060232.3, AC013361.4, AC004932.2,
AC044804.1, AC011186.3, AC019207.3, AC016061.3, AC016916.4, AC023470.2, AC016500.3, AC023567.2,
AC023399.2, AC016444.2, AC014380.1, AL356132.3, AL354884.2
SEQ ID NO: 566
ZH1402/T3

AL163203.2, AL050302.2, AP000026.1, AP000025.1, AL049911.2, NM_014915.1, AK001137.1, AB028997.1,
AC007617.10, AE003447.1, AL223186.1, AE003494.1, AC004739.1, AC006355.3, AC006045.2, U48386.1, AF027390.1,
AF044083.1, AL163233.2, AL163224.2, Z70270.1, Z74696.1, U41993.1, D82813.1, AP001679.1, AP001688.1,
AP001506.1, AP000961.2, AC005522.2, AC007379.2, AC006478.2, AC004996.1, AC007099.3, AC005100.2,
AC007100.3, AC005879.3, AC005331.1, AC005177.1, AC004045.1, AL133465.30, AL132766.13, AL109985.2,
AL078644.10, Z81103.1, Z81562.1, AL022395.2, Z82193.1, Y18930.1, AI951118.1, AW000914.1, AI922499.1,
M871874.1, AA991162.1, AA661357.1, C60377.1, AA471702.1, AA095151.1, AW519678.1, AV282871.1, AI902224.1,
AV045752.2, AI311562.1, AI075925.1, AA828186.1, AA812289.1, AA701829.1, AC067744.2, AL162272.3,
AC007351.16, AC021721.3, AC009401.2, AC027141.1, AC024370.2, AC014239.1, AC036209.2, AC060754.3,
AC062032.1, AC007131.3, AC061987.1, AC027699.1, AC016080.3, AC021187.4, AC013707.2, AC012410.2,
AC012542.4, AC012248.2, AC013152.1, AL139332.3, AP001455.1, AL022284.1, AC022418.3, AC008885.3,
AC027696.2, AC004932.2, AC019259.3, AC006281.6, AC023988.2, AC016444.2, AC005139.3, AL161730.3
SEQ ID NO: 567
ZH1402/T7

AL050302.2, AL163203.2, AL049911.2, NM_014915.1, AB028997.1, AB011137.2, AF090187.1, AC004499.1,
AL009051.1, AL138654.1, AP000365.1, AP000548.1, AC011661.5, AP001302.1, AC004936.2, AC006157.2, AL161940.6,
U40160.1, AC008912.4, AC004142.1, AC006996.2, AC009513.2, AC005358.1, AL161595.2, AL022605.3, X70810.1,
AL035531.17, AW373574.1, AW170035.1, AA759177.1, AL046701.1, AV242491.1, AV228746.1, AI957948.1,
C87958.1, AA837612.1, AA837592.1, AW469178.1, AW331138.1, AW320227.1, AW171900.1, AW087179.1,
AW052899.1, AW042526.1, AI972424.1, AI950371.1, AI920706.1, AI784583.1, AU072482.1, AU071886.1, AI684965.1,
AI460172.1, AI148480.1, AI093327.1, AI025802.1, AA990150.1, AA970354.1, AA708873.1, AA151117.1, AA150449.1,
AA149652.1, AA136980.1, AA101607.1, AA071350.1, W73028.1, H97559.1, H96023.1, AL157387.1, AL162272.3,
AC015940.2, AC022596.3, AC008088.2, AF228659.1, AC023067.3, AC016739.2, AC025384.2, AL354819.2,
AL157695.2, AL138965.3, AL137219.1, AL049185.4, AC068690.1, AC026427.2, AC008390.6, AC026081.2,
AC010785.3, AC016215.4, AC019042.3, AC0ZI 755.4, AC007342.2, AC012174.2, AC018792.2, AL356312.1,
AL161912.3
SEQ ID NO: 568
ZH154/T3

AP000025.1, AP000026.1, AL163203.2, AL050302.2, AL049911.2, NM_014915.1, AK001137.1, AB028997.1,
AC007617.10, AE003447.1, AJ223186.1, AC004739.1, AC006355.3, AC006045.2, U48386.1, AF044083.1, AL163224.2,
Z70270.1, Z74696.1, U41993.1, D82813.1, AP001679.1, AP001506.1, AP000961.2, AC005522.2, AC007379.2,
AE003459.1, AC006478.2, AC007099.3, AC005879.3, AC005650.1, AC005331.1, AC004045.1, AL163291.2,
AL132766.13, AL096867.15, AL078644.10, Z22180.1, AL021406.1, AL022395.2, Z82193.1, Y18930.1, AJ238787.1,
AJ238786.1, AP001746.1, AP001623.1, AI951118.1, AW000914.1, AI922499.1, M871874.1, AA991162.1, W08579.1,
AW030402.1, AA661357.1, c60377.1, AA471702.1, AA095151.1, AW611472.1, AW519678.1, AW449940.1,
AW394816.1, AV282871.1, AI902224.1, AVL21102.1, AV064061.1, AV051246.1, AV045752.2, AI311562.1,
AU045123.1, AI137187.1, AU021965.1, AU021770.1, AI075925.1, C87414.1, C85160.1, AA828186.1, AA701829.1,
AA667026.1, AA015732.1, AC067744.2, AL162272.3, AC007351.16, AC027141.1, AC024370.2, AC022175.1,
AC014239.1, AC035145.2, AC068481.1, AC061987.1, AC027699.1, AC012410.2, AC012248.2, AC013152.1,
AP001455.1, AC046187.2, AC026428.2, AC022418.3, AC010622.3, AC008885.3, AC027696.2, AC004932.2,
AC023988.2, AC016444.2, AC011128.2, AF186999.1, AC005139.3
SEQ ID NO: 569
ZH154/T7

AL163203.2, AL050302.2, AL049911.2, AP000542.1, AL163202.2, AP001464.1, NM_014915.1, AB028997.1,
AB011137.2, AF077534.1, AL009051.1, U32775.1, AL161957.1, AL110L20.11, AL075614.2, U19872.1, AP001465.1,
AK000712.1, AC008154.6, AC005670.1, AL133475.14, AL021633.2, AL096861.9, Z84482.1, AL080283.1, AW373574.1,
AI951118.1, AW297642.1, AA579752.1, AI989660.1, AI825717.1, AI084496.1, AA331953.1, AW614036.1, AI236531.1,
AI180434.1, M180260.1, AI176501.1, AA892166.1, AI058351.1, AI044283.1, AA464382.1, AW656081.1, AW656019.1,
AW564696.1, AI984814.1, AV127940.1, AI770175.1, AI446107.1, AA736439.1, AA219203.1, R62950.1, AW578955.1,
AW541472.1, AW540560.1, AW363481.1, AV350817.1, AV346364.1, AV322534.1, AI955034.1, AW179539.1,
AV131385.1, AI647944.1, AI631727.1, AI583901.1, AI368143.1, AI324262.1, AI193904.1, AI168669.1, AI133530.1,
AI086364.1, AI065683.1, AI008640.1, AA910838.1, AA738088.1, AA62.3276.1, AA554531.1, AA533501.1, AA518668.1,
AA423412.1, AA250678.1, AA222830.1, AA046147.1, AA046322.1, W54181.1, N72190.1, Z33598.1, AL157387.1,
AC024252.3, AL353626.1, AC036170.2, AL162272.3, AC067744.2, AC015940.2, AC008088.2, AC026271.2,
AC022596.3, AP000776.1, AL133290.3, AC011254.3, AC355499.5, AC024107.9, AC012435.6, AC011040.3,
AC010959.3, AC015650.1, AL133322.3, AP000872.2, AP001133.1, AC048371.2, AC068183.1, AC027493.2,
AC025485.2, AC021488.3, AC010994.9, AC011829.2, AL354771.1
SEQ ID NO: 570
ZH185/T3

AL163203.2, AL050302.2, AL049911.2, AP000026.1, AP000025.1, NM_014915.1, AK001137.1, AB028997.1,
AC007617.10, AE003447.1, A3223186.1, AE003494.1, AC004739.1, AC006355.3, AC006045.2, U48386.1, AC005177.1,
AF044083.1, AL163233.2, AL163224.2, Z70270.1, Z74696.1, U41993.1, D82813.1, AP001679.1, AP001688.1,
AP001506.1, AP000961.2, AC005522.2, AC008430.3, AC007379.2, AE003675.1, U91327.1, AC006478.2, AC004996.1,
AC007099.3, AC005100.2, AC007100.3, AC005879.3, AC006952.6, AC005331.1, AC004045.1, AL133465.30,
AF016685.1, AL132766.13, AL109985.2, AL078644.10, AL030999.2, AL022395.2, Z82193.1, Y18930.1, AI951118.1,
AW000914.1, AI922499.1, AI871874.1, AA991162.1, AA661357.1, C60377.1, AA471702.1, AA095151.1, AW819103.1,

TABLE 1-continued

Sequence homologies (GenBank Accession Numbers)

AW519678.1, AV282871.1, AI902224.1, AV045752.2, AI311562.1, AI075925.1, AA828186.1, AA701829.1, AC067744.2,
AL162272.3, AC009401.2, AC027141.1, AC024370.2, AC014239.1, AC036209.2, AC012622.4, AC024184.1,
AC061987.1, AC027699.1, AC013707.2, AC012410.2, AC019081.1, AC012248.2, AC013152.1, AL121993.6,
AP001455.1, AL022284.1, AC062015.2, AC046187.2, AC022418.3, AC012631.3, AC008885.3, AC011734.4,
AC025113.2, AC027696.2, AC004932.2, AC046156.1, AC026529.2, AC026035.2, AC011710.2, AC016916.4,
AC012549.2, AC023988.2, AC023567.2, AC009972.4, AC016444.2, AC011296.1, AL356132.3, AL355351.2
SEQ ID NO: 571
ZH185/T7

AL050302.2, AL163203.2, AL049911.2, NM_014915.1, AB028997.1, AB011137.2, AL009051.1, AL138654.1,
AP000365.1, AP000548.1, AC011661.5, AP001302.1, AE003737.1, AC004936.2, AC006157.2, AC006557.2, Z99291.1,
U40160.1, AC008526.5, AF156143.1, AC009402.3, AC004142.1, AC009513.2, AC006475.3, AC005760.1, AC005358.1,
AL161595.2, AL161592.2, AL022605.3, X70810.1, U58744.1, AL035538.1, X68658.1, Z11874.1, X17051.1,
AW373574.1, AW170035.1, AL046701.1, AA759177.1, AI957948.1, C87958.1, AW469178.1, AW415249.1,
AW338178.1, AW331138.1, AW320227.1, AW171900.1, AW087179.1, AW052899.1, AW042526.1, AI972424.1,
AI950371.1, AI920706.1, AI784583.1, AU072482.1, AI684965.1, AI4.60712.1, AI148480.1, AI093327.1, AI025802.1,
AA970354.1, AA708873.1, AA530141.1, AA151117.1, AA150449.1, AA149652.1, AA136980.1, AA101607.1,
AA071350.1, W73028.1, H97559.1, H96023.1, AL157387.1, AL162272.3, AC015940.2, AC022596.3, AC008088.2,
AL354819.2, AL157695.2, AL138965.3, AC023067.3, AC016739.2, AC026271.2, AC025384.2, AL161912.3,
AL137219.1, AL049185.4, AC068690.1, AC026427.2, AC010248.4, AC024590.2, AC011578.3, AC016684.1,
AC022124.3, AC008390.6, AC026081.2, AC025364.2, AC016215.4, AC019042.3, AC021755.4, AC011286.4,
AL356312.1, AL137221.4, AL137123.3
SEQ ID NO: 572
Group ZH184

AL050302.2, AL049911.2, AL163203.2, AL163202.2, AP001464.1, AP000542.1, AP000026.1, AP000025.1,
NM_014915.1, AB028997.1, AK001137.1, AC004902.2, AL009051.1, AJ223186.1, AC012654.2, U48386.1, AF044083.1,
AL163224.2, Z74696.1, AP001679.1, NM013469.1, AE003492.1, AC007250.2, AL163228.2, AL132766.13, U65986.1,
AP001683.1, X95911.1, AI951118.1, AW373574.1, AW297642.1, AI989660.1, AI825717.1, AA579752.1, AI084496.1,
AA331953.1, AW000914.1, AI922499.1, AI902224.1, AI871874.1, AA991162.1, AA464382.1, AW564696.1,
AW108479.1, AI984814.1, AV127940.1, AI770175.1, AA736439.1, AI686357.1, AA660701.1, C60377.1, AA471702.1,
AA219203.1, AA095151.1, AW208236.2, AW578955.1, AW541472.1, AW540560.1, AW519678.1, AW418577.1,
AW403036.1, AV346364.1, AV322534.1, AV282871.1, AV382738.1, AI935447.1, AI808313.1, AI790539.1, AI754384.1,
AI651636.1, AI647944.1, AI631727.1, AI591085.1, AI583901.1, AI478844.1, AU005907.1, AI360552.1, AI324262.1,
AI168669.1, AI150310.1, AI133530.1, AI086364.1, AI075925.1, AI065683.1, AA828186.1, AA74.6252.1, AA738088.1,
AA660895.1, AA660377.1, AA623276.1, AA518668.1, AA423412.1, AA280548.1, AA250678.1, AA222830.1,
AA151455.1, AA046147.1, AA046322.1, W54181.1, W16804.1, N72190.1, AC067744.2, AL157387.1, AC024252.3,
AL353626.1, AC036170.2, AL162272.3, AC008386.5, AC021384.3, AL356259.1, AP000776.1, AC017005.4,
AC026271.2, AC008088.2, AC027713.2, AC007131.3, AC027699.1, AL139091.2
SEQ ID NO: 573
Group ZH204

M33272.1, M62890.1, U09474.1, U09472.1, U09470.1, U85195.1, AE000658.1, U73702.1, AL022576.1, U29376.1,
U22025.1, U22019.1, U22017.1, AC000030.4 NM_002020.1, AF144731.1, AF177536.1, AC006276.1, AF000299.1,
L41927.1, AL163214.2, Z74581.1, Z49936.1, U22183.1, Z71646.1, U43143.1, AB004535.1, AP001669.1, M83665.1,
Z17240.1, X62534.1, X69878.1, X68203.1, M15825.1, D78303.1, AE003556.1, AE003513.1, AE003508.1, AF161775.1,
AF161773.1, AF161772.1, AF161771.1, AF161770.1, AF161769.1, AF161768.1, AF161767.1, AF161766.1, AF161765.1,
AF161764.1, AF161763.1, AC007529.5, M99575.1, AL161590.2, AL136538.1, AL035412.22, Z66525.1, Z99707.1,
AW415958.1, AA312591.1, AW748894.1, AW748893.1, AW748903.1, AI098848.1, AA007643.1, AA084882.1,
AU080777.1, AA263149.1, AI585542.1, AA546260.1, AA127538.1, AI505847.1, AW106399.1, AA285232.1,
AW456026.1, AI384994.1, AI588808.1, AA981002.1, AW866948.1, AW837857.1, AW803636.1, AW802295.1,
AW799320.1, AW799305.1, AW799215.1, AW795369.1, AW795283.1, AW795203.1, AW673780.1,
AW608831.1, AW605184.1, AW605160.1, AW605135.1, AW571487.1, AW468394.1, AW440973.1, AW403024.1,
AW291824.1, AW204191.1, AW327783.1, AW327724.1, AW167852.1, AI954999.1, AI954175.1, AI905275.1,
AI831782.1, AV159089.1, AI745038.1, AI683060.1, AA818062.1, AI380618.1, AI373115.1, AT355746.1, AI338618.1,
AI336359.1, AI133236.1, AI126474.1, AI022067.1, AA822594.1, AA580516.1, AA426205.1, AA172425.1, C02000.1,
W60824.1, T52063.1, AW876754.1, AW703947.1, AW568633.1, AI98 8524.1, AV197798.1, AV197063.1, AV195631.1,
AV192769.1, AV187686.1, AI738431.1, AV031963.1, AI441075.1, AA684640.1, AA611503.1, C60926.1, AA585860.1,
C44543.1, AA124367.1, AA050702.1, AL138878.3, AL139095.3, AC010893.4, AL109933.20, AC063933.3, AC025925.2,
AC024364.2, AC021185.2, AC023350.1, AC012452.3, AC021814.2, AC025520.2, AC016723.4, AC022335.6,
AC024911.1, AC018551.1, AC012041.8, AC010184.9, AC068985.2, AC022095.4, AC011544.5, AC026167.2,
AC027631.2, AC013364.7, AC008026.2, AC013350.6, AC022270.3, AC010892.3, AC009588.4, AC058333.2,
AC068808.4, AC015933.5, AC012000.2, AC010708.9, AC010037.4, AC012595.3, AL160153.4, AL157891.4
SEQ ID NO: 574
ZH092/T3

AL050302.2, AL049911.2, AL163203.2, AL163202.2, AP001464.1, AP000542.1, AP000026.1, AP000025.1,
NM_014915.1, AB028997.1, AK001137.1, AC004902.2, AL00g0511.1, AF077534.1, AC023602.5, AC012654.2, U40939.1,
AL133162.2, AL161957.1, U41993.1, AK000712.1, NM_013469.1, AC004079.1, AC005737.1, AL163228.2, Z69637.1,
U65986.1, L09228.1, AP001683.1, X95911.1, AI951118.1, AW373574.1, AW297642.1, AI989660.1, AI825717.1,
AA579752.1, AI084496.1, AA331953.1, AI902224.1, AA464382.1, AW564696.1, AW108479.1, AI984814.1,
AV127940.1, AI770175.1, AA736439.1, AA660701.1, C60377.1, AA219203.1, AW208236.2, AW578955.1, AW541472.1,
AW540560.1, AW519678.1, AW418577.1, AW363481.1, AW403036.1, AW262107.1, AV346364.1, AV322534.1,
AI935447.1, AI808313.1, AI790539.1, AI754384.1, AV045752.2, AI671778.1, AI647944.1, AI631727.1, M591085.1,
AI583901.1, AI478844.1, AI360552.1, AI324262.1, AI168669.1, AI150310.1, AI133530.1, AI086364.1, AI065683.1,
AA746252.1, AA738088.1, AA724030.1, AA660895.1, AA660377.1, AA623276.1, AA518668.1, AA423412.1,
AA280548.1, AA250678.1, AA222830.1, AA151455.1, AA046147.1, AA046322.1, W54181.1, W16804.1, N72190.1,

TABLE 1-continued

Sequence homologies (GenBank Accession Numbers)

AC067744.2, AC024252.3, AL353626.1, AL157387.1, AC036170.2, AL162272.3, AC008386.5, AC021384.3,
AL356259.1, AP000776.1, AC017005.4, AC026271.2, AC008088.2, AC011254.3, AC012582.3, AC013729.3,
AC024107.9, AC027713.2, AC011040.3, AC013733.3, AC055712.2, AC022139.3, AC021488.3, AC022773.2,
AC023402.2, AC011829.2, AL121955.9
SEQ ID NO: 575
ZH092/T7

AL035413.19, AL136295.2, AL163274.2, AP001729.1, AP000154.1, AC016025.12, AC025588.1, AC005779.1,
AC006285.11, AC007845.12, AC002470.17, AC007919.18, AC007308.13, AC005332.1, AL163262.2, AP001717.1,
AP000191.1, AP000553.1, AP000115.1, AL163290.2, AP001745.1, AL117258.2, AC007378.4, AC004841.2, AL022329.9,
AC011455.6, AC000004.1, AC007216.2, AC000353.27, U95742.1, AC005486.2, AC005048.2, AC005102.1, AC005057.2,
AC006965.3, AC002310.1, AC005089.2, AC005288.1, AL163261.2, AL031658.11, AL109758.1, AL049776.3,
AL031295.1, AL008718.23, AL078611.1, AP001716.1, Z79997.1, AC005049.2, AC005565.1, AC007227.3, AC003038.1,
AC005736.1, AC005527.3, AC004653.1, AL034380.26, AL022323.7, AC006028.3, AC006038.2, AC002045.1,
AC004491.1, AF088219.1, AC0048323, AC004922.2, AC004990.1, AC005011.2, AC005412.5, AC010170.3,
AC004578.2, AC005088.2, AC0063L2.8, AC006120.1, AC004675.1, AC004647.1, AL163216.2, AL133455.2,
AP001671.1, AP000555.1, AC004217.1, AL163293.2, AL096775.10, AL022476.2, Z78022.1, AP001748.1, AC005875.2,
AC005488.2, AC007792.1, Z85986.1, AC004826.3, AC002401.1, AC004858.2, AC006014.2, AC005072.2, AC003026.1,
AC003003.1, AC005694.3, AF109907.1, AC003688.1, AC002558.1, AL034549.16, AL049758.11, AW295538.1,
AA634538.1, AA634486.1, AI767517.1, AA400984.1, AW170035.1, AI765724.1, DS7390.1, M821400.1, AA664700.1,
F00440.1, AI914872.1, AI817516.1, AI355556.1, AL287627.1, AL287541.1, AW276817.1, AI873990.1, M537955.1,
AL284640.1, AA584637.1, AA580808.1, AA468022.1, W79504.1, AW872676.1, AW473163.1, AW043680.1, AI972203.1,
AI708009.1, AI085719.1, AA947364.1, AA618349.1, AA484373.1, AA225246.1, AA135357.1, N84237.1, T57267.1,
AW872575.1, AW862496.1, AW860542.1, AW500226.1, AW103769.1, AW090312.1, AI523897.1, AA745406.1,
AA525151.1, AA483330.1, AI633942.1, AA100599.1, W60328.1, AW071163.1, AI819574.1, AA745485.1, AA745475.1,
AA724333.1, AA281435.1, AA459749.1, N32813.1, AW022897.1, T05070.1, AW440215.1, AW274772.1, AW238120.1,
AW238092.1, AI924251.1, AI791819.1, AA570386.1, AA514295.1, AA229609.1, AA228418.1, AA228330.1,
AW504900.1, AI361525.1, AA729780.1, AA129446.1, W68362.1, AA947809.1, AA769402.1, AW440545.1, AA639073.1,
AA632036.1, W68497.1, N92756.1, H60533.1, AI014656.1, AA604333.1, AA179944.1, N35418.1, AI821596.1,
AA569183.1, R66544.1, AA747305.1, AA742424.1, AA722372.1, AA487567.1, AA483284.1, W68229.1, AL119729.1,
AI799327.1, AW085605.1, AL157387.2, AC010319.6, AC010189.4, AC069214.1, AC068533.2, AC011189.4,
AQ116688.4, AC021196.3, AC004555.2, AL137120.5, AL356356.1, AC067749.2, AC016586.4, AC010321.4,
AC009171.4, AC016700.2, AC020723.3, AC022621.4, AL136231.5, AL096708.33, AL160172.4, AL161728.2,
AL354733.4, AC010614.4, AC026763.5, AC025772.3, AC011492.5, AC019220.2, AL137853.8, AL158209.4,
AL157871.1, AC055806.3, AC010188.6, AC012018.7, AC055782.2, AC011085.4, AC020908.5, AC011495.3,
AC019360.3, AC026397.2, AC013728.3, AC019167.3, AC021778.3, AC015589.3, AJ239320.3, AL139143.4,
AL355312.3, AL354668.1, Z97197.3, AP001160.1, AC008761.3, AC007595.3, AC008427.5, AC013436.3, AC010184.9,
A0024215.7, AC025511.2, AC008569.5, AC008760.4, AC021138.4, AC027709.2, AC007366.3, AC022021.2,
AC004387.1, AL137139.3, A0018663.2, AC011598.6, AC044900.2, AC026046.4, AC025289.2, AC020931.3,
AC012626.4, AC008946.4, AC027726.2, AC004867.2, AC019260.4, AC0I9125.4, AC019166.4, AC011432.2,
AC005056.1, AL138895.7, AL034372.30, AL354740.4, AL158048.2, AL354677.1, AL158075.3, AC022038.2,
AC018639.6, AC024571.2, A0008540.3, AC023583.2, AC007637.7, AC009562.5, AC007163.2, AC004604.3,
AC005098.1, AL158172.2, AL158817.2, Z82199.1, AC025555.2
SEQ ID NO: 576
ZH112/T3

AL050302.2, AL049911.2, AL163203.2, AL163202.2, AP001464.1, AP000542.1, AP000026.1, AP000025.1,
NM_014915.1, AB028997.1, AL009051.1, AC004902.2, AF077534.1, AL035690.10, AC015600.6, AC023602.5,
AC012654.2, AC006355.3, U40939.1, AL133162.2, D87000.2, AE003492.1, AC004079.1, AF061415.1, AF061410.1,
AF061409.1, AF061408.1, AF061407.1, AF061406.1, AF061405.1, AF061404.1, AF061403.1, AF061402.1, X95911.1,
X63956.1, AL132639.2, AL139078.2, Y08926.1, AI951118.1, AW297642.1, AI989660.1, AI825717.1, AW373574.1,
AA521089.1, AA579752.1, AI084496.1, AA331953.1, AA464382.1, AA296607.1, AW564696.1, AV127940.1,
AA736439.1, C60377.1, AA219203.1, AW578955.1, AW541472.1, AW540560.1, AW418577.1, AW363481.1,
AW403036.1, AW297165.1, AW262107.1, AV346364.1, AV322534.1, AI935447.1, AI790539.1, AI754384.1,
AI671778.1, AI647944.1, AI631727.1, AI591085.1, AI583901.1, AI478844.1, AI360552.1, AI324262.1, AI168669.1,
AI150310.1, AI133530.1, AI086364.1, AI065683.1, AA746252.1, AA738088.1, AA724030.1, AA623276.1, AA518668.1,
AA423412.1, AA280548.1, AA250678.1, AA222830.1, AA151455.1, AA046147.1, AA046322.1, W54181.1, W16804.1,
N72190.1, H15988.1, Z42190.1, AL157387.2, AC067744.2, AC024252.3, AL353626.1, AC036170.2, AL162272.4,
AC008386.5, AC021384.3, AL356259.1, AP000776.1, AC017005.4, AC008429.3, AC025103.1, AC011254.3,
AC020682.2, AL353609.2, A0021821.3, AC021076.3, AC027716.2, AC036102.2, AC013452.3, AL139091.3,
AL121955.9, AL353894.3
SEQ ID NO: 577
Z112/T7

AL050302.2, AL163203.2, AL049911.2, NM_014915.1, AB028997.1, AB011137.2, AL009051.1, AL138654.1,
AP000365.1, AP000548.1, AC011661.5, AP001302.1, AC004936.2, AC006157.2, AF090187.1, AC006557.2, Z99291.1,
AL031599.1, U40160.1, AC008526.5, AF156143.1, AC009402.3, AC004142.1, AC009513.2, AC006475.3, AC005760.1,
AC005358.1, AL161595.2, Z11874.1, X70810.1, AL022605.3, AJ251973.1, U58744.1, X68658.1, X17051.1,
AW373574.1, AW170035.1, AL046701.1, AA759177.1, AI957948.1, C87958.1, AW469178.1, AW331138.1,
AW320227.1, AW171900.1, AW087179.1, AW052899.1, AW042526.1, AI972424.1, AI950371.1, AI920706.1,
AI784583.1, AU072482.1, AI684965.1, AI460172.1, AI148480.1, M093327.1, AI025802.1, AA970354.1, AA708873.1,
AA151117.1, AAI50449.1, AA149652.1, AA136980.1, AA101607.1, AA071350.1, W73028.1, W35.448.1, H97559.1,
H96023.1, AL157387.2, AL162272.4, AC022596.4, AC015940.2, AC008088.2, AL354819.2, AL157695.2, AL138965.3,
AC026271.3, AC023067.3, AC016739.2, AC025384.2, AL137219.1, AC068690.1, AC026427.2, AC010248.4,
AC024590.2, AC0I8440.3, AC016684.1, AC025076.3, AC060784.2, AC022124.3, AC008390.6, AC026081.2,
AC016215.4, AC019042.3, AC009499.2, AC021755.4, AC020749.2, AC012174.2, AC011286.4, AL132794.1,1,
AL356312.1, AL161912.3, AP001541.1

TABLE 1-continued

Sequence homologies (GenBank Accession Numbers)

SEQ ID NO: 578
ZH1219/T3

M33272.1, M62890.1, U73702.1, AL022576.1, U29376.1, U22025.1, U22019.1, U22017.1, NM_002020.1, AF144731.1,
AF177536.1, AC007122.1, AC006276.1, AF000299.1, L41927.1, AC003971.1, AL031736.16, AL163214.2, Z74581.1,
U43143.1, Z71646.1, M83665.1, AB004535.1, AP001669.1, Z17240.1, X62534.1, X69878.1, X68203.1, M15825.1,
D78303.1, AC012000.3, AC005970.2, AC006943.2,5, AE003681.1, AE003513.1, AE003508.1, AC005743.5,
NM_002233.1, AC004887.2, AC007529.5, AL161590.2, Z66525.1, U62741.1, AL136538.1, Z82178.2, AL035412.22,
U31328.1, M60450.1, D87445.2, M80206.1, L13404.1, M61185.1, L15313.1, X89626.1, AW415958.1, AA312591.1,
AW748894.1, AW748893.1, AW748903.1, AI098848.1 AA084882.1, AU080777.1, M585542.1, AA007643.1,
AA546260.1, AI505847.1, AW106399.1, AW456026.1, AA263149.1, AI384994.1, AI588808.1, AA981002.1,
AW879508.1, AW866948.1, AW837857.1, AW803636.1, AW802295.1, AW799320.1, AW799305.1, AW799215.1,
AW795369.1, AW795295.1, AW795283.1, AW795203.1, AW673780.1, AW608831.1, AW605184.1, AW605160.1,
AW605135.1, AW571487.1, AW468394.1, AW440973.1, AW291824.1, AW204191.1, AW327783.1, AW327724.1,
AW167852.1, AI954999.1, AI954175.1, AI905275.1, AI831782.1, AV159089.1, AI745038.1, AI683060.1, AA818062.1,
AI380618.1, AI373115.1, AI355746.1, AI338618.1, AI336359.1, AI133236.1, AI126474.1, AI022067.1, AA822594.1,
AA580516.1, AA426205.1, AA172425.1, AA127538.1, C02000.1, W60824.1, T52063.1, AW754153.1, AW703947.1,
AW568633.1, AW568193.1, AW543555.1, AW174306.1, AI987993.1, AI942415.1, AI914296.1, AV197798.1,
AV197063.1, AV195631.1, AV187218.1, AI856536.1, AI856317.1, AI546306.1, AI441075.1, AI337102.1, AI082230.1,
AU023412.1, AA684640.1, AL139095.5, AL138878.4, AC024364.3, AC063933.3, AC053521.3, AC025925.2,
AC021185.2, AC023350.1, AC012452.3, AC010893.4, AL109933.21, AC026790.2, AC025399.2, AC034197.2,
AC021814.2, AC026219.1, AC016723.4, AC007218.2, AC024911.1, AC018551.1, AC008026.3, AC010184.9,
AC026034.3, AC022095.4, ACX111544.5, AC025700.3, AC013364.7, AC025494.2, AC018740.2, AC023364.3,
AC022270.3, AC010892.3, AC009588.4, AF130418.2, AC006916.1, AL354926.1, AP001560.1, AC009543.4,
AL239326.3, AP001810.1
SEQ ID NO: 582
ZH1356/T3

AK000577.1, NM_016223.1, AF130979.1, NM_011861.1, X85124.1, AF188630.1 NM_011862.1, AF128535.1,
A8037800.1, AE003840.1, AF139495.1, AF139494.1, AF139493.1, AF139492.1, NM_007229.1, AF128536.1,
AF104402.1, AL022476.2, AC007680.2, AF030876.1, AC004561.2, AC012467.9, AE003731.1, AE003480.1, L27063.1,
AF031075.1, AF094828.1, AC007021.3, AF055895.1, U52112.1, X99335.1, AL009204.1, AB041584.1, D14068.1,
AB020878.1, AW328241.1, AI415693.1, AI427270.1, W46097.1, AA171908.1, AW908012.1, W24724.1, AA499441.1,
AA289880.1, AA793579.1, W44248.1, W24725.1, AW408380.1, AW641932.1, AL119244.1, AW762532.1, AW471083.1,
AW255104.1, AI627848.1, AL275465.1, H81644.1, AL275938.1, AW492862.1, AW098801.1, AW086524.1, AI881986.1,
AI645579.1, AA994288.1, AA902835.1, AA844675.1, AA757670.1, AA620827.1, AA518826.1, AA140167.1, W57231.1,
AC024045.3, AL157372.6, AC025634.1, AC014463.1, Z82199.1, AC012469.6, AL158217.3, AC013307.5, AC034099.2,
AC012515.11, AC012264.8, AC011938.3, AC010787.3, AC022488.2, AC023204.1, AC007771.6, AC010988.3,
AC013305.4, AC017943.1, AC015396.1, AL138894.3, AL353773.1, AL353141.1, AP001459.1, AP000803.1
SEQ ID NO: 583
ZH1356/T7

NM_016223.1, AF130979.1, AK000577.1, AB037800.1, NM_014063.1, AC011599.8, AF197060.1, AF196968.1,
NM_010840.1, AF105994.1, Z82244.1, AF030227.1, AC010386.5, AE003810.1, AF239824.1, AC005775.1,
NM_005428.2, NM_011862.1, NM_005957.1, U09806.2, AF105983.1, AC008151.1, AC007649.12, AC008369.1,
AF128535.1, AC006057.5, AL163302.2, AL109938.8, Z93096.1, U30327.1, A.1237672.1, X16316.1, X92487.1,
AK001717.1, AK000868.1, AP000501.1, AP000350.1, AW199981.1, AA576536.1, AW439879.1, AA587394.1,
AI075695.1, AI735027.1, AA218860.1, AI749755.1, AW206358.1, AA452508.1, AI073515.1, AW328242.1, F25077.1,
AL283940.1, AI828816.1, AI741698.1, AA454093.1, AL280249.1, AI826261.1, F26225.1, AI567379.1, AA171893.1,
AA350150.1, AI354257.1, AL251129.1, AW129660.1, AI357160.1, H24638.1, F36700.1, F26293.1, M270014.1,
AI952189.1, AA834233.1, AI689497.1, AI688448.1, AW362737.1, N93072.1, F17480.2, AW431729.1, AW413130.1,
Z38509.1, AI594932.1, AW251630.1, AA016415.1, AA015524.1, AA949399.1, N93071.1, AI838941.1, AW273866.1,
AI480991.1, AA924922.1, AI706853.1, AA103104.1, AW357203.1, AW184060.1, AW048905.1, AI706877.1,
AA061854.1, AW522470.1, AI619781.1, AI579120.1, AI017889.1, AA324499.1, H22790.1, AW385462.1, AW404930.1,
AW252629.1, AW247807.1, AA193529.1, AW804483.1, AW575217.1, AW495689.1, AW347757.1, AI886795.1,
AI886722.1, AI491469.2, AA898753.1, AA628345.1, AA084232.1, R82530.1, AC024045.3, AC027737.3, AL157372.6,
AC048379.2, AC004580.2, AC004579.1, AC004394.1, AC069271.2, AC026441.2, AC020982.3, AC016648.4,
AC026218.2, AC018505.3, AC018843.2, AC018831.3, AC022377.1, AC012550.1, AL161448.3, AC027052.3,
AC007569.8, AC012246.3, AL354832.2, AC025996.4, AC041022.3, AC068282.3, AC020922.5, AC010976.4,
AC026386.4, AC053497.2, AC021384.3, AC019103.4, AC023063.7, AC022892.1, AC017160.1, AC013313.1,
AC010878.1, AC007791.13, AC008095.2, AL121777.17, AL139327.13, AL356356.1, AL035456.24, AL354944.2,
AL355360.2, AL161652.5, Z95330.10
SEQ ID NO: 584
ZH1375/T3

AC068499.1, Z92780.1, AJ251880.1, AF239701.1, AC006795.2, AE002918.1, AE002665.1, AC009311.2, AC005066.1,
AC012561.2, X79076.1, AL022721.1, AL356173.1, AL163220.2, X83524.1, AP001675.1, AP000958.2, ABO11479.1,
M28161.1, AA428948.1, AI879131.1, R15907.1, AA040001.1, AI967928.1, AW071642.1, Z43817.1, AI149361.1,
AW785553.1, AA448896.1, AI436690.1, M831898.1, AI800263.1, AL262999.1, AI984945.1, AA655517.1, AI344209.1,
AW326298.1, AW355025.1, AA717582.1, AW446558.1, AW408623.1, AI026945.1, AI535381.1, AW837103.1,
AW352814.1, AL202924.1, M 156144.1, AW647549.1, AW404545.1, AW246104.1, W60604.1, X94529.1, AI624509.1,
AW912173.1, BB001328.1, AW767552.1, AW680443.1, AV351077.1, AW158556.1, AV218637.1, AW060414.1,
AV148236.1, AI527650.1, AI353655.1, AA764432.1, C77297.1, AA434896.1, AA414285.1, AA137699.1, AA069209.1,
AC019054.3, AC012103.2, AC040963.2, AC032024.3, AC012220.5, AC008118.12, AC007553.1,1, AC009762.4,
AC018531.4, AC016896.3, AP001264.1, AC018412.3, AC025749.2, AL355522.2, AC007622.17, AC024225.8,
AC024224.6, AC022507.12, AC032002.2, AC022547.3, AC018731.4, AC027469.2, AC023837.8, AC044890.1,
AC012421.6, AC025384.2, AC009554.4, AC024713.2, AC024417.2, AC013777.3

TABLE 1-continued

Sequence homologies (GenBank Accession Numbers)

SEQ ID NO: 585
ZH1375/T7

Z99281.1, U95974.1, AC005702.1, AL161533.2, AL078606.1, AB010074.1, AF145751.1, AE003429.1, AL021978.1, Z83237.1, AC001226.1, AL050391.1, AL022100.13, Z82185.1, Z68871.1, Z97200.1, AL035209.1, AB005229.1, D88363.1, AA040001.1, AI026945.1, Z43817.1, AW404545.1, N59030.1, AA024476.1, AI879131.1, AA028041.1, AW326298.1, AA428948.1, AA655517.1, AW071642.1, AI967928.1, AI831898.1, AL262999.1, AI149361.1, AI535381.1, AW837103.1, AW575737.1, AW785553.1, AW352814.1, AA717582.1, AI156144.1, RI 5907.1, AL202924.1, AI605706.1, AA589995.1, AA546348.1, AA210197.1, AW123704.1, AA455901.1, AA415948.1, AW355025.1, AW610618.1, X94529.1, AI984945.1, AI800263.1, AI436690.1, AI344209.1, M007144.1, AI007142.1, AI124576.1, W26293.1, AW680443.1, AW446558.1, W12131.1, AV373768.1, AV369884.1, AV351169.1, AI908470.1, AI822397.1, AA888988.1, AA342115.1, AC019054.3, AC021615.4, AC018614.3, Z92841.1, AC012220.5, AC009762.4, AL138900.4, AC025048.3, AC068211.1, AC023352.3, AC010096.4, AC010803.2, AL355674.2, AC009774.4, AC012027.10, AC068300.4, AC025033.5, AC020979.2, AC016553.4, AC010295.4, AC010523.4, AC024679.2, AC013447.3, AC062005.1, AC034172.2, AC041026.1, AC025601.2, AC011043.3, AC016800.2, AC011841.3, AC023418.1, AC007502.2, AC007500.2, AC020785.2, AC022385.1, AC023714.2, AC012357.3, AC010885.3, AC010936.2, AC013211.1, AL138795.3, AL109942.8, AL157767.5, AL162399.3, AL008882.1, AP002004.1, Z98869.1

SEQ ID NO: 586
ZH1393/T3

AE003550.1, AC009476.3, NM_012382.1, AC004822.1, AF023244.1, U39726.1, U39731.1, AB015506.1, AB015503.1, AP000079.1, AP000419.1, AE001697.1, Z72502.1, AL237785.1, AJ390496.1, AJ007794.1, X54057.1, AP001306.1, AP000382.1, AC007682.2, M63080.1, AW372449.1, AI391312.1, W18534.1, AU035125.1, AW158249.1, AI599734.1, AA963894.1, AA963691.1, AI408537.1, AA901042.1, AI043558.1, AA917049.1, AA551615.1, AA550464.1, AW919867.1, AW864050.1, AW351172.1, AW347411.1, AW238579.1, AV255372.1, AW111079.1, AW111078.1, AW011763.1, AV146281.1, AI721947.1, AV030796.1, AI648977.1, AI574183.1, AI509914.1, AI465745.1, AL240036.1, AI178270.1, AI080964.1, AI041718.1, AA929446.1, AA869764.1, AA839185.1, AA690360.1, AA619492.1, AA162490.1, AA118105.1, N21983.1, H02265.1, AC021473.3, AC016310.5, AC067925.1, AC015700.4, AC018955.2, AC019351.3, AC011291.4, AC025702.3, AC010560.5, AC020323.1, AL138928.2, AC068844.1, AC023271.3, AC021401.4, AC019045.4, AC026906.2, AC026493.3, AC018881.4, AC016710.3, AC024019.3, AC024215.7, AC027793.2, AC032015.2, AC026462.1, AC011840.3, AC015574.4, AC010703.2, AC013774.2, AL133211.3, AL138782.5, AL133462.13

SEQ ID NO: 587
ZH1393/T7

AL031599.1, AF050118.1, AL161518.2, AL049525.1, AL008627.1, AC020633.3, AE003780.1, AE003591.1, AC007676.19, U07083.1, AL163290.2, Z98885.1, AP001745.1, AP001619.1, D64003.1, X74961.1, AB006697.1, AC007869.2, AC004553.1, AC004544.1, Z68752.1, M16110.1, AL136132.15, AL132987.2, AL117325.3, U21916.1, T41007.1, AM38272.1, AI885274.1, AW486134.1, AL283076.1, AL266380.1, R96130.1, AW024037.1, AA004253.1, U67496.1, AA972439.1, AW061311.1, R96089.1, AV345769.1, M414381.1, AI671785.1, AW372449.1, AI490448.1, AI485909.1, AU081238.1, AU075592.1, AU029967.1, AW532756.1, AJ399099.1, AJ393365.1, AW614987.1, AW477467.1, AW442849.1, AW294222.1, AW039440.1, AL036419.1, AI485533.1, H29685.1, AC021473.3, AC016310.5, AC010736.4, AC022932.2, AL355346.4, AP001591.1, AC024109.9, AC021631.4, AC026702.3, AC008387.4, AC008571.3, AC008478.5, AC027463.2, AC009841.6, AC020114.1, AC012727.1, AL353798.5, AC069290.1, AC055821.2, AC008495.4, AC060800.1, AC024658.3, AC019044.2, AC018381.1, AL139152.2, AL158036.3, AL355505.2, Z99776.1, AL021150.1

SEQ ID NO: 588
ZH172/T3

AL137730.1, AK000015.1, A0009046.4, AC011745.3, AL161541.2, Z97338.2, U53729.1, AL114938.1, AC004669.2, AE003635.1, AC007321.2, AC005711.1, AC005922.1, AF068624.1, AL020991.1, Z82086.1, AL160236.2, AL132766.13, AL023694.1, Z83821.1, Z48432.1, Z74065.1, M12624.1, Z94847.1, AC007391.3, AP001549.1, AC004253.1, U67496.1, AL161584.2, AL031032.1, AL109838.11, AL096862.18, U39652.1, I78076.1, M367972.1, AA815204.1, N52394.1, AW607992.1, T86971.1, AW303429.1, AW196107.1, H87717.1, AI703119.1, AV145264.1, AA872637.1, AI350255.1, AW371247.1, AW414549.1, AA932625.1, AW143059.1, AA679262.1, AI803182.1, AU034554.1, N76675.1, AW812434.1, AW799395.1, AW799392.1, AW799279.1, AW730293.1, AJ397496.1, AV251422.1, AW141778.1, AI862716.1, AV023111.1, AI137198.1, AA765214.1, 062559.1, AA094474.1, AA068788.1, N88898.1, H57885.1, AL353664.3, AC026292.2, AC023120.3, AC011672.3, AC011675.2, AC016390.3, AL354661.2, AC068286.2, A0069133.1, AC025734.2, AC007923.2, AC019342.4, AC022030.1, AC012197.2, AC006779.3, AL157765.2, AL356385.1, AL117380.27, AL050349.25, AL162872.1, AL049185.4

SEQ ID NO: 589
ZH172/T7

AL137730.1, AC005166.1, AK000015.1, AE003829.1, M88598.1, AI631928.1, AI632212.1, AA679262.1, AI379984.1, AI699932.1, AA599222.1, AI418143.1, N89840.1, AW414549.1, AW149244.1, AL289633.1, H09271.1, AW242064.1, AI590137.1, AI174360.1, AA937186.1, AA648294.1, H16062.1, N57911.1, H93047.1, H00210.1, R64228.1, F03754.1, R82998.1, AW476207.1, AI301228.1, R56117.1, AA186021.1, L23805.1, AL298048.1, R58994.1, T15413.1, AI608031.1, R96918.1, AI539849.1, AW709322.1, AA047078.1, AI661161.1, AA289460.1, AW143059.1, AI010543.1, AI362025.1, AI170628.1, R82955.1, AV134041.1, AI981623.1, AI010920.1, AA260878.1, AL356363.1, AC013599.5, AC026662.2, A0025933.2, A0035142.2, AC0187543, A0007398.5, A0007352.8, AC017698.1, AL157763.2

SEQ ID NO: 590
ZH184/T3

AL049911.2, AL163203.2, AL050302.2, AP000542.1, AL163202.2, AP001464.1, AP000026.1, AP000025.1, NM_014915.1, AK001137.1, AB028997.1, AE003447.1, AJ223186.1, A0015600.6, AE003494.1, A0004739.1, AC006355.3, AC006045.2, U48386.1, AF044083.1, AL161578.2, AL021633.2, Z70270.1, AL080283.1, AL163233.2, AL163224.2, Z74696.1, 1.141993.1, D82813.1, AP001679.1, AP001688.1, AP001506.1, AP000961.2, AC005522.2,

TABLE 1-continued

Sequence homologies (GenBank Accession Numbers)

AC008929.3, AC007379.2, AE003664.1, AE003509.1, AC012654.2, AC004079.1, AC006478.2, AC004996.1,
AC005100.2, AC007100.3, AC005879.3, AC007617.10, AC007437.16, AC005331.1, AC004045.1, Y18930.1, Z99116.1,
X95911.1, AL117195.1, X63956.1, AL032637.1, AL109925.11, AL133465.30, AL132639.2, AL132766.13, AL109985.2,
AL078644.10, AL050322.10, AL022395.2, Z82193.1, Y15880.1, L09228.1, M84227.1, AI951118.1, AW373574.1,
AA579752.1, AI989660.1, AI825717.1, AW000914.1, AI922499.1, M871874.1, AA991162.1, AV127940.1, AA736439.1,
C60377.1, AA219203.1, AA095151.1, AW578955.1, AW418577.1, AW363481.1, AW403036.1, AW262107.1,
AV346364.1, AV322534.1, AV282871.1, AI935447.1, AI902224.1, AI754384.1, AV045752.2, AI671778.1, AI591085.1,
AI583901.1, AI478844.1, AI360552.1, AI311562.1, AI168669.1, AI150310.1, AI086364.1, AA828186.1, AA746252.1,
AA724030.1, AA701829.1, AA280548.1, AA151455.1, W16804.1, N72190.1, AC067744.2, AC036170.2, AL157387.2,
AC0242523, AL353626.1, AL162272.4, AP000776.1, AC017005.4, AC009401.2, AC011254.3, AC012582.3,
AC012551.3, AC014239.1, AC062004.2, AC068739.2, AC036209.2, AC007131.3, AC061987.1, AC027699.1,
A0012542.4, AC012248.2, AC013152.1, AP001133.1, AL022284.1
SEQ ID NO: 591
ZH184/T7

AL109985.2, AL031662.25, AL163282.2, AC006323.3, AC003684.1, AC011310.3, AF217796.1, AC002564.1,
AC004130.1, AC004990.1, AC008062.2, AC004987.2, AC006213.1, AF001549.1, AC004638.1, AC004087.1,
AF042090.1, AL049709.15, AL031542.1, AL157756.2, AL133399.1, AL031224.1, AC004263.1, AC004019.20,
AC000052.16, AC004417.1, AC010170.3, AC007957.35, AC025588.1, AC007899.3, AC004854.2, AC004875.1,
AC006006.2, AC005412.5, AC007193.1, AC002402.1, AC023494.12, AL137039.1, AL021808.1, AL163262.2,
AL121601.13, AL035697.19, AL008582.11, AL035458.35, Z93930.10, AP001717.1, AP001410.1, AP000I90.1,
AP000159.1, AP000047.1, AP000046.1, AP000302.1, AP000557.2, D87009.1, AP000556.2, AP000114.1, AC004890.2,
AC002310.1, AC005523.1, AF088219.1, AL031589.10, Z93023.1, AC008039.1, AC010722.2, AC025436.2, AC009087.4,
AC009079.4, AF168787.1, AC006111.2, AC006012.2, AF039907.1, AC006312.8, AC005901.1, AC005772.1,
AC005754.1, AC005755.1, AC004496.1, Z93241.11, AL163223.2, U62293.1, AL031178.1, AP001678.1, AP001256.2,
AB023049.1, AP000555.1, AC005072.2, AF006752.1, AF207550.1, AL163230.2, AL121653.2, AP001685.1, AC000004.1,
AC007030.3, AC004821.2, AC006125.1, AL035695.17, AL239318.3, AP000432.4, AC005565.1, AC002115.1,
AA553710.1, R72458.1, AI471543.1, F36273.1, AL284640.1, AI610159.1, AW193265.1, AI471481.1, AI334443.1,
AI053672.1, AA542991.1, AW673241.1, AA825357.1, AA810370.1, AA3 50859.1, N25296.1, AW769399.1, AW511743.1,
AW276827.1, AW193432.1, AW088058.1, AL046409.1, AI688846.1, AI613280.1, AI431303.1, AI350211.1, AI341664.1,
AI061334.1, AA179136.1, AL281697.1, AW338086.1, AI358343.1, AA678436.1, AA644538.1, AA521399.1, AA521323.1,
T07451.1, AW731867.1, AW166815.1, AW162049.1, AW029038.1, AI929531.1, AI904894.1, AF150222.1, AI375710.1,
AI344844.1, AI340453.1, AL281881.1, AI133164.1, AA649642.1, AA176924.1, AA134367.1, AA084070.1, AW339568.1,
AF150152.1, AI379719.1, AA771811.1, AA491814.1, AA156538.1, AW276817.1, AI339850.1, AA191620.1,
AW833903.1, AW517377.1, M887483.1, AA664015.1, AA599920.1, AA533725.1, AA483223.1, W79504.1,
AW600804.1, AW517721.1, F32808.1, AI567674.1, AI168185.1, AA747472.1, AA719805.1, AA630030.1, AA244357.1,
N55273.1, AW303196.1, AW301350.1, AW274349.1, AA581903.1, N71930.1, AW833898.1, AI358571.1, AW265385.1,
AL119691.1, AI830390.1, AL298710.1, AA970213.1, AA834713.1, AA280632.1, AA364429.1, T56472.1, AW327868.1,
AL042853.2, AI537955.1, AA338522.1, AL157387.2, AC010377.4, AL355887.1, AC022931.3, AL137224.3, AL354864.1,
AC021879.3, AC005973.4, AC011484.2, AC026331.3, AC025175.2, AC022668.3, AC027472.3, AC012146.4,
AC027393.3, AC023359.7, AC035 341.2, AC012042.9, AC021160.3, AC021957.3, AC026397.2, AC011768.4,
AC025054.2, AC013648.3, AC011844.3, AC022989.2, AC022845.2, AC017078.3, AC013733.3, AC010165.2,
AL049537.36, AL136969.5, AL353715.3, AL159175.4, AL138703.2, AL136223.3, AL157372.6, AP000631.3,
AC019222.3, AL354723.1, AC055879.2, AC016555.4, AC009122.5, AC016334.2, AC034119.1, AC007721.15,
AL136221.8, AC027096.3, AC021103.6, AC046165.2, AC053540.2, AC010363.5, AC009040.4, AC027709.2,
AC009506.3, AC008531.2, AC016700.2, AC011430.4, AC025935.2, AC012141.2, AC012308.4, AC018573.2,
AC015758.3, AC022791.1, AC021661.1, AL158830.6, AL354935.3, AC016586.4, AC010649.5, AC011490.4,
AC008746.5, AC021634.4, AL355515.2, AC026141.3, AC009417.2, AC005910.5, AC008688.6, AC027550.2,
AC068364.1, AC023133.2, AC026300.2, AC018560.3, AC025818.2, AC020780.3, AC011840.3, AC007799.4,
AF129075.1, AL161728.2, AL109824.23, AP000931.2, AC064828.3, AL353720.2, AC068889.4, AC021805.3,
AC022621.4, AC016688.4, AL162726.3, AC009070.5, AC021474.3, AL121752.8
SEQ ID NO: 592
ZH204/T3

M33272.1, M62890.1, AC003974.2, D86074.1, NM_001231.1, AE003658.1, NM_007550.1, S73775.1, U85195.1,
AE000658.1, U73702.1, U29376.1, AB008674.1, Z98263.1, NM_000057.1, NC_001147.1, AC005517.6, AC008545.3,
AE003701.1, AF214653.1, NM_002095.1, AC002534.1, U71195.1, AF067418.1, AF005030.1, Z72749.1, AC000379.1,
U83248.1, AL137267.1, S46792.1, S67861.1, AJ006995.1, U22183.1, AJ238237.1, U39817.1, U05314.1, Z73546.1,
Z74961.1, Z70678.1, X64324.1, X63469.1, D37935.1, J05080.1, M17028.1, X88900.1, AJ006966.1, AC013430.4,
AF198100.1, AE003626.1, AE003455.1, AL161594.2, AL035679.1, AL035331.1, X90518.1, AL121806.2, AL030978.1,
AL353993.1, AL355925.1, AL034558.2, X53233.1, X87371.1, X94607.1, AP000388.1, AB009050.1, AA312591.1,
AW415958.1, AW745894.1, AW748893.1, AW748903.1, AI098848.1, AA007643.1, AU080777.1, AA084882.1,
AI585542.1, AA546260.1, AA263149.1, AI505847.1, AW106399.1, AA127538.1, AA285232.1, AW456026.1,
AI588808.1, AI384994.1, AA981002.1, AW566712.1, AI787751.1, AW536727.1, AW431150.1, AV265194.1,
AV219084.1, AI844907.1, AI842969.1, AV160844.1, AV165707.1, AV124038.1, AV779552.1, AV085555.1, AV047038.2,
AV046630.2, AI325552.1, AU045190.1, AU018790.1, AU016981.1, AU016595.1, AU016513.1, AU015043.1,
AU014858.1, AA252091.1, AA197255.1, AA108210.1, Z74637.1, F01019.1, AW705280.1, AJ281093.1, AW398070.1,
AW398039.1, AW397497.1, AW397370.1, AW397141.1, AW397013.1, AW396970.1, AW396868.1, AW395825.1,
AW395703.1, AW395679.1, AW395606.1, AW395515.1, AW225544.1, AW186387.1, AI973567.1, AI960869.1,
AI941243.1, AI941225.1, AI940836.1, AI883261.1, AL079496.1, AI795023.1, AI759696.1, AI748161.1, AI748087.1,
AI736054.1, AI736025.1, AI736012.1, AI406060.1, AI109316.1, AI109205.1, AI063325.1, AA902197.1, AA784297.1,
AA553106.1, AA497210.1, AA466795.1, AA462438.1, AA432643.1, AA313904.1, C13433.1, F12959.1, AV185121.1,
C66585.1, AL138878.4, AL139095.5, AC010893.4, AL109933.21, AC025343.2, AC008760.4, AC024364.3, AC063933.3,
AC025925.2, AC021185.2, AC023350.1, AC016546.4, AC034197.2, AC021814.2, AC026219.1, AC016723.4,
AC007218.2, AC012373.13, AC022890.1, AC017288.1, AC018551.1, AC015313.1, AL139011.6, AP001075.2,
AC025685.2, AC061978.2, AC008427.5, AC021869.6, AC027631.2, AC026233.2, AC013364.7, AC013350.6,
AC026232.1, AC018740.2, AC023364.3, AC008050.3, AC024301.1, AC010003.5, AC009368.5, AC017158.1,

TABLE 1-continued

Sequence homologies (GenBank Accession Numbers)

AC008367.3, AC020124.1, AF215848.1, AC008236.3, AC017830.1, AC017944.1, AC012952.1, AL1fl026.2, AL049185.4, AC068808.4, AC037424.7, AC016634.4, AC008904.3, AC009550.3, AC021972.2, AC020804.2, AC021305.3, AC023103.3, AC020080.1, AC020324.1, AC012195.2, AL138711.3, AL160153.4, AL031745.7
SEQ ID NO: 593
ZH204/T7

AC012599.8, AC004092.1, L78822.1, L04666.1, NC_001146.1, NM005711.1, AC005919.1, AC005788.1, AC003036.1, U70312.1, AF003530.1, X74595.1, Z71448.1, L20973.1, L19930.1, AI686567.1, AW073551.1, AA007617.1, AA702832.1, AA778768.1, AA127539.1, AA085379.1, F31106.1, AW196506.1, F36537.1, AW137246.1, AW268860.1, AW582844.1, AI118179.1, AI651413.1, AW324433.1, AI465698.1, AA073164.1, AW390105.1, AA856137.1, AA577233.1, AA648320.1, AI990395.1, AA072738.1, AI904456.1, AU024036.1, AI702678.1, AA127538.1, AI904448.1, AV359288.1, AI420526.1, AL221321.1, AV292110.1, AI616122.1, AA693126.1, AW215056.1, AV318953.1, AI561593.1, AA153299.1, AA007643.1, AA689696.1, AW431906.1, AV374296.1, AV155600.1, AL138878.4, AL139095.5, AC005842.6, AC024410.2, AC053543.3, AC008502.4, AC024218.2, AC009292.7, AC055730.3, AC009362.6, AC007351.16, AC055710.3, AC025577.10, AC024219.7, AC024146.5, AC022265.2, AC068656.1, AC016639.5, AC008422.1, AC016632.4, AC008914.3, AC025763.2, AC024164.2, AC023194.3, AC034249.1, AC016441.4, AC024469.1, AL049185.4

TABLE 2

Relation between nucleotide sequences and polypeptide sequences

| Nucleic acid SEQ ID NO | Polypeptide SEQ ID NO |
|---|---|
| 1 | 665 |
| 2 | 678 |
| 3 | 679 |
| 4 | 761, 762 |
| 5 | 763, 764, 765 |
| 6 | 782 |
| 7 | 783 |
| 8 | 767 |
| 9 | 604 |
| 10 | — |
| 11 | 606 |
| 12 | 624 |
| 13 | 599 |
| 14 | 776, 777, 778 779 |
| 15 | 780, 781 |
| 16 | 802 |
| 17 | 803 |
| 18 | 607 |
| 19 | 594 |
| 20 | 595, 596, 597 |
| 21 | — |
| 22 | 598 |
| 23 | |
| 24 | 600 |
| 25 | |
| 26 | 601 |
| 27 | — |
| 28 | 602 |
| 29 | 603 |
| 30 | 605 |
| 31 | — |
| 32 | 608 |
| 33 | 609 |
| 34 | 610 |
| 35 | 611, 612 |
| 36 | — |
| 37 | — |
| 38 | 613 |
| 39 | 614 |
| 40 | — |
| 41 | 615 |
| 42 | — |
| 43 | 616 |
| 44 | — |
| 45 | 617, 618 |
| 46 | 619 |
| 47 | 620 |
| 48 | 621 |
| 49 | — |
| 50 | 622 |
| 51 | 623 |
| 52 | 625 |
| 53 | — |
| 54 | 626 |
| 55 | 627, 628 |
| 56 | 629 |
| 57 | — |
| 58 | 630 |
| 59 | — |
| 60 | 631 |
| 61 | 632 |
| 62 | — |
| 63 | 633 |
| 64 | 634 |
| 65 | 635 |
| 66 | — |
| 67 | 636 |
| 68 | — |
| 69 | 637 |
| 70 | — |
| 71 | — |
| 72 | — |
| 73 | — |
| 74 | — |
| 75 | — |
| 76 | — |
| 77 | 638 |
| 78 | — |
| 79 | — |
| 80 | — |
| 81 | 639 |
| 82 | — |
| 83 | 640 |
| 84 | 641 |
| 85 | — |
| 86 | 642 |
| 87 | — |
| 88 | 643 |
| 89 | — |
| 90 | 644 |
| 91 | — |
| 92 | 645 |
| 93 | 646 |
| 94 | 647 |
| 95 | 648 |

TABLE 2-continued

Relation between nucleotide sequences and polypeptide sequences

| Nucleic acid SEQ ID NO | Polypeptide SEQ ID NO |
|---|---|
| 96 | 649, 650 |
| 97 | 651, 652 |
| 98 | 653 |
| 99 | 654 |
| 100 | 655 |
| 101 | 656 |
| 102 | 657 |
| 103 | 658 |
| 104 | 659, 660 |
| 105 | 661 |
| 106 | 662, 663 |
| 107 | 664 |
| 108 | 666 |
| 109 | 667 |
| 110 | — |
| 111 | 668, 669, 670 |
| 112 | 671, 672, 673, 674, 675 |
| 113 | 676 |
| 114 | 677 |
| 115 | 680 |
| 116 | 681 |
| 117 | 682, 683 |
| 118 | 684 |
| 119 | 685 |
| 120 | 686 |
| 121 | 687, 688 |
| 122 | 689, 690, 691 |
| 123 | 692 |
| 124 | 693, 694 |
| 125 | 695 |
| 126 | 696 |
| 127 | 697 |
| 128 | 698 |
| 129 | 699 |
| 130 | 700, 701, 702 |
| 131 | 703, 704 |
| 132 | 705 |
| 133 | 706, 707 |
| 134 | 708 |
| 135 | 709, 710 |
| 136 | 711 |
| 137 | 712 |
| 138 | 713 |
| 139 | 714 |
| 140 | 715 |
| 141 | 716 |
| 142 | 717 |
| 143 | 718 |
| 144 | 719 |
| 145 | 720 |
| 146 | 721 |
| 147 | 722 |
| 148 | 723, 724 |
| 149 | 725, 726 |
| 150 | 727 |
| 151 | 728, 729 |
| 152 | 730, 731 |
| 153 | 732, 733 |
| 154 | 734, 735, 736 |
| 155 | 737 |
| 156 | 738 |
| 157 | 739, 740 |
| 158 | 741 |
| 159 | 742, 743, 744 |
| 160 | 745 |
| 161 | 746 |
| 162 | 747, 748 |
| 163 | 749 |
| 164 | 750 |
| 165 | 751, 752 |
| 166 | 753 |
| 167 | 754, 755, 756 |
| 168 | 757, 758, 759, 760 |
| 169 | 766 |
| 170 | 768 |
| 171 | 769 |
| 172 | 770 |
| 173 | 771 |
| 174 | 772 |
| 175 | 773, 774, 775 |
| 176 | 784 |
| 177 | 785 |
| 178 | 786, 787, 788 |
| 179 | — |
| 180 | 789 |
| 181 | 790 |
| 182 | 791 |
| 183 | 792, 793 |
| 184 | 794 |
| 185 | 795, 796 |
| 186 | 797, 798, 799, 800 |
| 187 | 801 |
| 188 | 804, 805 |
| 189 | 806 |
| 190 | 807 |
| 191 | 808, 809 |
| 192 | 810 |
| 193 | 811 |
| 194 | 812 |
| 195 | 813 |
| 196 | 814 |
| 197 | 815 |
| 198 | 816, 817 |
| 199 | 818 |
| 200 | 819, 820 |
| 201 | 821 |
| 202 | 822 |
| 203 | 823, 824 |
| 204 | 825, 826 |
| 205 | 827, 828, 829 |
| 206 | 830, 831 |
| 207 | 832 |
| 208 | 833 |
| 209 | 834, 835 |
| 210 | 836, 837 |
| 211 | 838 |
| 212 | 839, 840, 841 |
| 213 | 842, 843 |
| 214 | 844, 845, 846 |
| 215 | 847, 848 |
| 216 | 849 |
| 217 | 850, 851, 852 |
| 218 | 853, 854 |
| 219 | — |
| 220 | — |
| 221 | 855, 856, 857 |
| 222 | 858, 859, 860 |
| 223 | 861, 862, 863 |
| 224 | 864 |
| 225 | 865 |
| 226 | 866, 867, 868 |
| 227 | 869, 870 |
| 228 | 871 |
| 229 | 872 |
| 230 | 873 |
| 231 | 874 |
| 232 | 875, 876, 877 |
| 233 | 878 |
| 234 | 879, 880 |
| 235 | 881, 882 |
| 236 | 883 |
| 237 | 884, 885 |
| 238 | 886 |
| 239 | 887, 888 |
| 240 | — |

TABLE 2-continued

Relation between nucleotide sequences and polypeptide sequences

| Nucleic acid SEQ ID NO | Polypeptide SEQ ID NO |
| --- | --- |
| 241 | 889, 890 |
| 242 | 891, 892 |
| 243 | 893, 894 |
| 244 | 895 |
| 245 | 896 |
| 246 | 897 |
| 247 | 898 |
| 248 | 899 |
| 249 | 900, 901 |
| 250 | 902 |
| 251 | 903 |
| 252 | 904 |
| 253 | 905 |
| 254 | 906 |
| 255 | 907, 908, 909 |
| 256 | 910, 911 |
| 257 | 912, 913, 914 |
| 258 | 915 |
| 259 | 916 |
| 260 | 917, 918, 918 |
| 261 | 920, 921 |
| 262 | 922, 923 |
| 263 | 924, 925, 926 |
| 264 | 927, 928, 929 |
| 265 | 930, 931 |
| 266 | 932 |
| 267 | 933, 934 |
| 268 | 935 |
| 269 | 936 |
| 270 | 937, 938 |
| 271 | 939 |
| 272 | 940 |
| 273 | 941, 942 |
| 274 | 943, 944 |
| 275 | 945 |
| 276 | 946, 947, 948 |
| 277 | 949 |
| 278 | 950, 951, 952 |
| 279 | 953, 954 |
| 280 | 955, 956 |
| 281 | — |
| 282 | 957 |
| 283 | 958 |
| 284 | 959 |
| 285 | 960, 961 |
| 286 | — |
| 287 | 962, 963, 964 |
| 288 | 965 |
| 289 | 966 |
| 290 | 967, 968, 969, 970 |
| 291 | 971, 972, 973, 974 |
| 292 | 975, 976 |
| 293 | 977, 978, 979, 980 |
| 294 | 981, 982, 983 |
| 295 | 984, 985 |
| 296 | 986, 987 |
| 297 | 988, 989 |
| 298 | 990 |
| 299 | 991 |
| 300 | 992 |
| 301 | 993 |
| 302 | 994 |
| 303 | 995 |
| 304 | 996 |
| 305 | 997 |
| 306 | 998 |
| 307 | 999 |
| 308 | 1000, 1001 |
| 309 | 1002, 1003 |
| 310 | 1004, 1005 |
| 311 | 1006, 1007, 1008 |

TABLE 2-continued

Relation between nucleotide sequences and polypeptide sequences

| Nucleic acid SEQ ID NO | Polypeptide SEQ ID NO |
| --- | --- |
| 312 | 1009, 1010 |
| 313 | 1011, 1012, 1013 |
| 314 | 1014, 1015 |
| 315 | 1016, 1017 |
| 316 | 1018, 1019 |
| 317 | 1020 |
| 318 | 1021 |
| 319 | 1022 |
| 320 | 1023 |
| 321 | 1024, 1025, 1026 |
| 322 | 1027, 1028, 1029, 1030 |
| 323 | 1031, 1032, 1033 |
| 324 | 1034, 1035, 1036 |
| 325 | 1037, 1038 |
| 326 | 1039, 1040 |
| 327 | 1041, 1042, 1043, 1044 |
| 328 | 1045, 1046 |
| 329 | 1047 |
| 330 | 1048, 1049 |
| 331 | 1050 |
| 332 | 1051, 1052 |
| 333 | 1053 |
| 334 | 1054, 1055 |
| 335 | 1056 |
| 336 | 1057, 1058 |
| 337 | 1059 |
| 338 | 1060, 1061 |
| 339 | 1062 |
| 340 | 1063 |
| 341 | 1064, 1065 |
| 342 | 1066 |
| 343 | 1067, 1068 |
| 344 | 1069 |
| 345 | 1070, 1071 |
| 346 | 1072 |
| 347 | 1073, 1074 |
| 348 | 1075, 1076 |
| 349 | 1077, 1078, 1079 |
| 350 | 1080 |
| 351 | 1081 |
| 352 | 1082, 1083 |
| 353 | 1084 |
| 354 | 1085 |
| 355 | — |
| 356 | 1086 |
| 357 | — |
| 358 | 1087 |
| 359 | 1088 |
| 360 | 1089 |
| 361 | 1090 |
| 362 | 1091 |
| 363 | — |
| 364 | 1092 |
| 365 | — |
| 366 | 1093 |
| 367 | 1094 |
| 368 | 1095 |
| 369 | 1096 |
| 370 | 1097 |
| 371 | — |
| 372 | — |
| 373 | 1098 |
| 374 | 1099 |
| 375 | — |
| 376 | 1100 |
| 377 | 1101 |
| 378 | 1102 |
| 379 | 1103 |
| 380 | 1104 |
| 381 | 1105 |
| 382 | 1106 |
| 383 | 1107 |

TABLE 2-continued

Relation between nucleotide sequences and polypeptide sequences

| Nucleic acid SEQ ID NO | Polypeptide SEQ ID NO |
| --- | --- |
| 384 | 1108 |
| 385 | — |
| 386 | 1109 |
| 387 | 1110 |
| 388 | 1111 |
| 389 | — |
| 390 | 1112 |
| 391 | — |
| 392 | 1113 |
| 393 | 1114 |
| 394 | 1115 |
| 395 | — |
| 396 | 1116 |
| 397 | 1117 |
| 398 | — |
| 399 | 1118 |
| 400 | 1119 |
| 401 | 1120 |
| 402 | — |
| 403 | 1121 |
| 404 | 1122 |
| 405 | 1123 |
| 406 | 1124 |
| 407 | — |
| 408 | — |
| 409 | 1125 |
| 410 | — |
| 411 | 1126 |
| 412 | 1127 |
| 413 | 1128 |
| 414 | — |
| 415 | 1129 |
| 416 | 1130, 1131, 1132 |
| 417 | 1133 |
| 418 | 1134 |
| 419 | 1135, 1136 |
| 420 | 1137, 1138 |
| 421 | 1139 |
| 422 | — |
| 423 | 1140 |
| 424 | 1141, 1142 |
| 425 | 1143 |
| 426 | 1144, 1145 |
| 427 | — |
| 428 | 1146, 1147 |
| 429 | 1148, 1149, 1150 |
| 430 | — |
| 431 | 1151 |
| 432 | 1152 |
| 433 | — |
| 434 | 1153 |
| 435 | 1154 |
| 436 | — |
| 437 | 1155 |
| 438 | 1156 |
| 439 | — |
| 440 | 1157 |
| 441 | 1158 |
| 442 | 1159 |
| 443 | 1160 |
| 444 | 1161 |
| 445 | 1162 |
| 446 | — |
| 447 | 1163 |
| 448 | — |
| 449 | 1164 |
| 450 | 1165 |
| 451 | 1166 |
| 452 | — |
| 453 | 1167 |
| 454 | — |
| 455 | 1168 |
| 456 | — |
| 457 | 1169 |
| 458 | 1170 |
| 459 | 1171 |
| 460 | 1172 |
| 461 | 1173, 1174, 1175 |
| 462 | 1176, 1177 |
| 463 | 1178 |
| 464 | 1179 |
| 465 | 1180 |
| 466 | 1181, 1182, 1183 |
| 467 | 1184 |
| 468 | 1185 |
| 469 | 1186 |
| 470 | 1187 |
| 471 | 1188 |
| 472 | — |
| 473 | 1189 |
| 474 | 1190 |
| 475 | — |
| 476 | 1191, 1192 |
| 477 | 1193 |
| 478 | 1194 |
| 479 | 1195 |
| 480 | 1196 |
| 481 | 1197 |
| 482 | 1198 |
| 483 | 1199 |
| 484 | 1200, 1201 |
| 485 | 1202 |
| 486 | 1203 |
| 487 | 1204 |
| 488 | 1205 |
| 489 | 1206 |
| 490 | 1207 |
| 491 | 1208 |
| 492 | 1209 |
| 493 | 1210 |
| 494 | — |
| 495 | 1211 |
| 496 | 1212 |
| 497 | 1213 |
| 498 | — |
| 499 | 1214 |
| 500 | — |
| 501 | 1215 |
| 502 | 1216 |
| 503 | 1217 |
| 504 | 1218 |
| 505 | 1219 |
| 506 | 1220 |
| 507 | 1221 |
| 508 | 1222 |
| 509 | — |
| 510 | 1223 |
| 511 | 1224 |
| 512 | 1225 |
| 513 | 1226 |
| 514 | 1227 |
| 515 | 1228 |
| 516 | 1229, 1230 |
| 517 | 1231 |
| 518 | — |
| 519 | 1232 |
| 520 | 1233 |
| 521 | 1234 |
| 522 | 1235 |
| 523 | — |
| 524 | 1236 |
| 525 | — |
| 526 | 1237 |
| 527 | — |
| 528 | 1238 |
| 529 | 1239 |
| 530 | 1240, 1241 |
| 531 | 1242, 1243, 1244 |

TABLE 2-continued

Relation between nucleotide sequences and polypeptide sequences

| Nucleic acid SEQ ID NO | Polypeptide SEQ ID NO |
|---|---|
| 532 | 1245 |
| 533 | 1246, 1247 |
| 534 | — |
| 535 | 1248 |
| 536 | 1249, 1250, 1251 |
| 537 | 1252, 1253, 1254 |
| 538 | — |
| 539 | 1255 |
| 540 | 1256 |
| 541 | 1257 |
| 542 | 1258 |
| 543 | 1259, 1260 |
| 544 | 1261 |
| 545 | 1262 |
| 546 | 1263 |
| 547 | 1264 |
| 548 | 1265, 1266 |
| 549 | 1267 |
| 550 | — |
| 551 | 1268 |
| 552 | 1269, 1270 |
| 553 | 1271, 1272 |
| 554 | 1273, 1274 |
| 555 | 1275 |
| 556 | 1276 |
| 557 | 1277 |
| 558 | 1278 |
| 559 | 1279 |
| 560 | 1280 |
| 561 | 1281 |
| 562 | 1282, 1283 |
| 563 | 1284, 1285 |
| 564 | 1286, 1287 |
| 565 | 1288, 1289, 1290 |
| 566 | 1291, 1292 |
| 567 | 1293, 1294 |
| 568 | 1295 |
| 569 | 1296, 1297, 1298 |
| 570 | 1299 |
| 571 | 1300 |
| 572 | 1301 |
| 573 | 1302, 1303 |
| 574 | 1304 |
| 575 | — |
| 576 | 1305, 1306 |
| 577 | 1307 |
| 578 | 1308 |
| 579 | 1309 |
| 580 | 1310 |
| 581 | 1311, 1312, 1313 |
| 582 | 1314, 1315, 1316 |
| 583 | 1317, 1318 |
| 584 | 1319 |
| 585 | 1320, 1321 |
| 586 | 1322 |
| 587 | 1323, 1324 |
| 588 | 1325 |
| 589 | 1326 |
| 590 | 1327 |
| 591 | 1328, 1329 |
| 592 | 1330, 1331 |
| 593 | 1332 |

Example 2

Preparation of Recombinant Cancer Associated Antigens

To facilitate screening of patients' sera for antibodies reactive with cancer associated antigens, for example by ELISA, recombinant proteins are prepared according to standard procedures. Where gaps exist in the gene sequences represented by the clones disclosed herein, or where flanking sequences are desired, such nucleic acid sequences can be isolated according to standard procedures. For example, where 5' and 3' clones of a gene sequence are known, PCR primers can be designed for amplification of the nucleotide sequence between the clones. Flanking sequences can be isolated using procedures such as RACE PCR Such sequences also can be isolated by standard hybridization cloning protocols.

In one method of preparing recombinant cancer associated antigens, the clones encoding cancer associated antigens are subcloned into a baculovirus expression vector, and the recombinant expression vectors are introduced into appropriate insect cells. Baculovirus/insect cloning systems are preferred because post-translational modifications are carried out in the insect cells. Another preferred eukaryotic system is the *Drosophila* Expression System from Invitrogen. Clones which express high amounts of the recombinant protein are selected and used to produce the recombinant proteins. The recombinant proteins are tested for antibody recognition using serum from the patient which was used to isolated the particular clone, or in the case of cancer associated antigens recognized by allogeneic sera, by the sera from any of the patients used to isolate the clones or sera which recognize the clones' gene products.

Alternatively, the cancer associated antigen clones are inserted into a prokaryotic expression vector for production of recombinant proteins in bacteria Other systems, including yeast expression systems and mammalian cell culture systems also can be used.

Example 3

Preparation of Antibodies to Cancer Associated Antigens

The recombinant cancer associated antigens produced as in Example 2 above are used to generate polyclonal antisera and monoclonal antibodies according to standard procedures. The antisera and antibodies so produced are tested for correct recognition of the cancer associated antigens by using the antisera/antibodies in assays of cell extracts of patients known to express the particular cancer associated antigen (e.g. an ELISA assay). These antibodies can be used for experimental purposes (e.g. localization of the cancer associated antigens, immunoprecipitations, Western blots, etc.) as well as diagnostic purposes (e.g., testing extracts of tissue biopsies, testing for the presence of cancer associated antigens).

Example 4

Expression of Breast, Gastric and Prostate Cancer Associated Antigens in Cancers of Similar and Different Origin The expression of one or more of the breast, gastric and/or prostate cancer associated antigens is tested in a range of tumor samples to determine which, if any, other malignancies should be diagnosed and/or treated by the methods described herein. Tumor cell lines and tumor samples are tested for cancer associated antigen expression, preferably by RT-PCR according to standard procedures. Northern blots also are used to test the expression of the cancer associated antigens. Antibody based assays, such as ELISA and western blot, also can be used to determine protein expression. A preferred method of testing expression of cancer associated antigens (in other cancers and in additional same type cancer patients) is allogeneic serotyping using a modified SEREX protocol (as described above).

In all of the foregoing, extracts from the tumors of patients who provided sera for the initial isolation of the cancer associated antigens are used as positive controls. The cells containing recombinant expression vectors described in the Examples above also can be used as positive controls.

The results generated from the foregoing experiments provide panels of multiple cancer associated nucleic acids and/or polypeptides for use in diagnostic (e.g. determining the existence of cancer, determining the prognosis of a patient undergoing therapy, etc.) and therapeutic methods (e.g., vaccine composition, etc.).

Example 5

HLA Typing of Patients Positive for Cancer Associated Antigen

To determine which HLA molecules present peptides derived from the cancer associated antigens, cells of the patients which express the breast and/or gastric cancer associated antigens are HLA typed. Peripheral blood lymphocytes are taken from the patient and typed for HLA class I or class I, as well as for the particular subtype of class I or class II. Tumor biopsy samples also can be used for typing. HLA typing can be carried out by any of the standard methods in the art of clinical immunology, such as by recognition by specific monoclonal antibodies, or by HLA allele-specific PCR (e.g. as described in WO97/31126).

Example 6

Characterization of Cancer Associated Antigen Peptides Presented by MHC Class I and Class II Molecules Antigens which provoke an antibody response in a subject may also provoke a cell-mediated immune response. Cells process proteins into peptides for presentation on MHC class I or class II molecules on the cell surface for immune surveillance. Peptides presented by certain MHC/HLA molecules generally conform to motifs. These motifs are known in some cases, and can be used to screen the breast and/or gastric cancer associated antigens for the presence of potential class I and/or class II peptides. Summaries of class I and class II motifs have been published (e.g., Rammensee et al., *Immunogenetics* 41:178–228, 1995). Based on the results of experiments such as those described above, the HLA types which present the individual breast cancer associated antigens are known. Motifs of peptides presented by these HLA molecules thus are preferentially searched.

One also can search for class I and class II motifs using computer algorithms. For example, computer programs for predicting potential CTL epitopes based on known class I motifs has been described (see, e.g., Parker et al, *J. Immunol.* 152:163, 1994; D'Amaro et al., *Human Immunol.* 43:13–18, 1995; Drijfhout et al., *Human Immunol.* 43:1–12, 1995). HLA binding predictions can conveniently be made using an algorithm available via the Internet on the National Institutes of Health World Wide Web site at URL http://bimas.dcrt.nih.gov. Methods for determining HLA class II peptides and making substitutions thereto are also known (see, e.g. International applications PCT/US96/03182 and PCT/US98/01373). Computer software for selecting HLA class II binding peptides is also available (TEPITOPE; Sturniolo et al., *Nature Biotechnol.* 17:555–561, 1999; Manici et al., *J. Exp. Med.* 189:871–876, 1999). Peptides which are thus selected can be for inducing specific CD4$^+$ lymphocytes and identification of peptides. Additional methods of selecting and testing peptides for HLA class II binding are well known in the art.

Example 7

Identification of the Portion of a Cancer Associated Polypeptide Encoding an Antigen To determine if the cancer associated antigens isolated as described above can provoke a cytolytic T lymphocyte response, the following method is performed. CTL clones are generated by stimulating the peripheral blood lymphocytes (PBLs) of a patient with autologous normal cells transfected with one of the clones encoding a cancer associated antigen polypeptide or with irradiated PBLs loaded with synthetic peptides corresponding to the putative protein and matching the consensus for the appropriate HLA class I molecule (as described above) to localize an antigenic peptide within the cancer associated antigen clone (see, e.g., Knuth et al., *Proc. Natl. Acad. Sci. USA* 81:3511–3515, 1984; van der Bruggen et al., *Eur. J. Immunol.* 24:3038–3043, 1994). These CTL clones are screened for specificity against COS cells transfected with the cancer associated antigen clone and autologous HLA alleles as described by Brichard et al. (*Eur. J. Immunol.* 26:224–230, 1996). CTL recognition of a cancer associated antigen is determined by measuring release of TNF from the cytolytic T lymphocyte or by $^{51}$Cr release assay (Herin et al., *Int. J. Cancer* 39:390–396, 1987). If a CTL clone specifically recognizes a transfected COS cell, then shorter fragments of the cancer associated antigen clone transfected in that COS cell are tested to identify the region of the gene that encodes the peptide. Fragments of the cancer associated antigen clone are prepared by exonuclease m digestion or other standard molecular biology methods. Synthetic peptides are prepared to confirm the exact sequence of the antigen.

Optionally, shorter fragments of cancer associated antigen cDNAs are generated by PCR. Shorter fragments are used to provoke TNF release or $^{51}$Cr release as above.

Synthetic peptides corresponding to portions of the shortest fragment of the cancer associated antigen clone which provokes TNF release are prepared. Progressively shorter peptides are synthesized to determine the optimal cancer associated antigen tumor rejection antigen peptides for a given HLA molecule.

A similar method is performed to determine if the cancer associated antigen contains one or more HLA class II peptides recognized by T cells. One can search the sequence of the cancer associated antigen polypeptides for HLA class II motifs as described above. In contrast to class I peptides, class II peptides are presented by a limited number of cell types. Thus for these experiments, dendritic cells or B cell clones which express HLA class II molecules preferably are used.

Example 8

Recognition of Cancer Antigens by Cancer Patient Sera

Several of the cancer antigen identified herein were tested for reactivity with sera from normal and breast cancer patients according to standard procedures (e.g., the SEREX procedure outlined above).

TABLE 3

Serology of antigens

| SEQ ID NO | Gene/Clone | Breast Cancer Patient Sera | Normal Sera |
|---|---|---|---|
| 1 | Br-38/HSP105 (MK) | 6/31 | 0/30 |
| 2, 3 | Br-39/HSP105 (MK) | 3/31 | 0/30 |
| 4, 5 | RGS-GAIP interacting protein GIPC (MK) | 3/31 | 0/30 |
| 6, 7 | NS1-binding protein/KIAA0850 (MK) | 3/31 | 0/30 |
| 8 | Opa-interacting protein OIP2 (MK) | 3/31 | 0/30 |
| 9, 10 | Kinesin family protein 3B (KIF3B) (MT) | 2/31 | 0/30 |
| 11 | Endothelial-monocyte activating protein (EMAP2) (MT) | 2/31 | 0/30 |
| 12 | Unknown TOM1 protein (MT311) | 2/31 | 0/30 |
| 13 | Outer mitochodrial membrane protein 34 kDa (MT) | 1/31 | 0/30 |
| 14, 15 | IPL (MK) | 1/31 | 0/30 |
| 16, 17 | Mus ACF7 neural isoform (MK) | 1/31 | 0/30 |
| 18 | Cyclin D3 (MT) | 1/31 | 0/30 |

The data show that proteins encoded by SEQ ID NO:1–12 were recognized by multiple breast cancer patients' sera, but not by control individuals' sera. Proteins encoded by SEQ ID NO:13–18 were recognized by only a single breast cancer patient's sera, but not by control individuals' sera. The

EQUIVALENTS

Those skilled in the art will recognize, or be able to ascertain using no more than routine experimentation, many equivalents to the specific embodiments of the invention described herein. Such equivalents are intended to be encompassed by the following claims.

All references disclosed herein are incorporated by reference in their entirety.

SEQUENCE LISTING (1332 sequences)

SEQ ID NO: 1 - DNA, 1231 bp, Homo sapiens
  misc_feature (787)..(787): n is a, c, g, or t/u
  misc_feature (1114)..(1114): n is a, c, g, or t/u
gagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagctttaagtctgtagtctttatgatcctaaaagggaaaattgccttggtaactttcagattcctgtggaattgtgaattcatactaagctttctgtgcagtctcnccatttgcatcactgaggatgaaactgacttttgtcttttggagaaaaaaaacttgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcnctatacagtatattgtcatgtgaaagtgtggaatggaagaaatgtcgatcctgttgtaactgattgtgaacacttttatgagctttaaaataaagttcatcttatggtgtcatttct

SEQ ID NO: 2 - DNA, 965 bp, Homo sapiens
  misc_feature (831)..(831): n is a, c, g, or t/u
  misc_feature (841)..(841): n is a, c, g, or t/u
  misc_feature (850)..(850): n is a, c, g, or t/u
  misc_feature (869)..(869): n is a, c, g, or t/u
  misc_feature (873)..(873): n is a, c, g, or t/u
  misc_feature (900)..(900): n is a, c, g, or t/u
  misc_feature (923)..(923): n is a, c, g, or t/u
  misc_feature (952)..(952): n is a, c, g, or t/u
ggagaatgaaatgtcttctgaagctgacatggagtgtctgaatcagagaccaccagaaaacccagacactgataaaaatgtccagcaagacaacagtgaagctggaacacagccccaggtacaaactgatgctcaacaaacctcacagtctcccccttcacctgaacttacctcagaagaaaacaaaatcccagatgctgacaaagcaaatgaaaaaaaagttgaccagcctccagaagctaaaaagcccaaaataaaggtggtgaatgttgagctgcctattgaagccaacttggtctggcagttagggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaaagaacggcccaaaaatgtttgaagaactaggacagaggctgcagcatttatgcccagatagcagctgacttcagaaataagggtgagaaataccacctttttggatgagtcttgaaatgaaaaaagtgggaaaaatctgttaatgaagtgattgggaatggattgaataatgtcttgaaagctcaggctaaaaagaagtcttggatcagggntccaattgtnctgcctccnggaaatttaaaacaaaaantcangggaattgggaccccccattgtggaanccgttgttacccaaccccgaaanccaaaaattggattcccccccaactgggnaaaaacctccaaa

SEQ ID NO: 3 - DNA, 799 bp, Homo sapiens
  misc_feature (716)..(716): n is a, c, g, or t/u
  misc_feature (747)..(747): n is a, c, g, or t/u
attctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgataaaaatgtccagcaagacaacagtgaagctggaacacagccccaggtacaaactgatgctcaacaaacctcacagtctcccccttcacctgaacttacctcagaagaaaacaaaatcccagatgctgacaaagcaaatgaaaaaaaagttgaccagcctccagaagctaaaaagcccaaaataaaggtggtgaatgttgagctgcctattgaagccaacttggtctggcagttagggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaaattttttgaggactcctcacagaaaactggaagaactggcttgttttgaagaaagggagangaccaagcttaaaccaagcatatgttgacangtttgggaagaattaatgaaaaattggcacttccagtttaaggttcggtttc

SEQ ID NO: 4 - DNA, 141 bp, Homo sapiens
cccacttctcgctgctcatgccgctgggactggggcggcggaaaaaggcgccccctctagtggaaaatgaggaggctgagccaggccgtggagggctgggcgtgggggagccagggcctctgggcggaggtgggtcggggg

SEQ ID NO: 5 - DNA, 608 bp, Homo sapiens
  misc_feature (150)..(150): n is a, c, g, or t/u
  misc_feature (175)..(175): n is a, c, g, or t/u
  misc_feature (281)..(281): n is a, c, g, or t/u
  misc_feature (525)..(525): n is a, c, g, or t/u
  misc_feature (547)..(547): n is a, c, g, or t/u
  misc_feature (567)..(567): n is a, c, g, or t/u
  misc_feature (576)..(576): n is a, c, g, or t/u
  misc_feature (578)..(578): n is a, c, g, or t/u
  misc_feature (581)..(581): n is a, c, g, or t/u
ggcagattgattctttatgttcaagacagcaaattcagatacaaaaacccaccgccatcgtccctccctccctcctgctctgggccagggatgggcctggaaggaaaaattggaggtggggaggaggttgcggggttcacagcaaactcntgtcaaatgcggaggtaacaggctncacagggagggggctcctctcaggaggggtgagggcattattgcatttgctggggggaaggacaaccctctcccctgtattccctgcgtcaggaaactaggaaggncatgacccccaaacagaacccaaggccccagggagacagagggaccagtttggcagctgatggtggaaagtggtggaggcgggggtggccccccaatttggctgatccctcccctccctgtgcctgacccaactgaggtaggtggggaacagggcacaggggggccggggaccccggccagactgggaaccagggaggggatggtcccattggagcggggcaaggggcctggcccacctccctnccattgtccttgggctgcttanctagctcagctggaggctcnggtcctgantnaangtccctgctgggggcccccccaggtgc

SEQ ID NO: 6 - DNA, 397 bp, Homo sapiens
gcaacacaaagcttttgcatattgcatactattaaacatgctgtacatactttttgggtttatttggaaaggaatgcaaagatgaaggtctgttttgtgtacttttaagactttggttattttactttttggaaaagaataaaccaagaattgattgggcacatcatttcaagaagtcccctctcctccacatttgttttgccaatttgcacattaaatgactcttccctcaaatgtgtactatggggtaaaaggggtagggtttaaagatgtagacagttgggttttttaagggccctttttcaataactggaacactctataacaaaggatacttatttaaatagatgacattgactatttttgtttttattaaaaggaagcttacatgcctacc

SEQ ID NO: 7 - DNA, 396 bp, Homo sapiens
  misc_feature (3)..(3): n is a, c, g, or t/u
  misc_feature (129)..(129): n is a, c, g, or t/u
  misc_feature (215)..(215): n is a, c, g, or t/u
ggnaggcatgtaagcttccttttaataaaaacaaaaatagtcaatgtcatctatttaaataagtatcctttgttatagagtgttccagttattgaaaaagggcccttaaaaaacccaactgtctacatntttaaaccctaccccttttaccccatagtacacatttgagggaagagtcatttaatgtgcaaattggcaaaacaaatgtggagganaggggacttcttgaaatgatgtgcccaatcaattcttggtttattcttttccaaaaagtaaaataaccaaagtcttaaaagtacacaaaacagaccttcatctttgcattcctttccaaataaacccaaaaagtatgtacagcatgtttaatagtatgcaatatgcaaaagctttgtgttg

SEQ ID NO: 8 - DNA, 933 bp, Homo sapiens
  misc_feature (36)..(36): n is a, c, g, or t/u
  misc_feature (171)..(171): n is a, c, g, or t/u
  misc_feature (177)..(177): n is a, c, g, or t/u
  misc_feature (179)..(179): n is a, c, g, or t/u
  misc_feature (699)..(699): n is a, c, g, or t/u
  misc_feature (706)..(706): n is a, c, g, or t/u
ggaagatggcggctgggttcaaaaccgtggaacctntggagtattacaggagatttctgaaagagaactgccgtcctgatggaagagaacttggtgaattcagaaccacaactgtcaacatcggttcaattagtaccgcagatggttctgctttagtgaagttgggaaatnctacantnatctgtggagttaaagcagaatttgcagcaccatcaacagatgcccctgataaaggatacgttgttcctaatgtggatctaccacccctgtgttcatcgagattccggtctggacctcctggagaagaggcccaagtggctagccaattcattgcagatgtcattgaaaattcacagataattcagaaagaggacttatgcatttctccaggaaagcttgtctgggttctatactgtgatctcatttgcctcgactacgatggaaacattttggatgcctgcacatttgctttgtagcggctttaaaaaatgacagttgcctgaagttactataaatgaagaaactgctttagcagaagttaatttaaagaagaaaagttatttgaatattagaactcatccagttgcaacttcctttgctgtgtttgatgacactttgcttatagttgaccctactggagaggaggaacatctggcaacaggaaccttaacaatagtaatggatgaggaaggcaaactntgttgtnttcacaaaccaggtggaagtgggctaactggagctaaacttcaggactgtatgagccgagcagttacaagacacaaagaagttaaaaaactgatggatgaagtaattaagagtatgaaacccaaataaacagccaccacattttcaaaacagatttgtaaaaattgtatttgttaacactgtgcacaaacgttttatactaaataaatatcaaactacattcttctg

SEQ ID NO: 9 - DNA, 738 bp, Homo sapiens
  misc_feature (276)..(276): n is a, c, g, or t/u
  misc_feature (399)..(399): n is a, c, g, or t/u
  misc_feature (451)..(451): n is a, c, g, or t/u
  misc_feature (470)..(470): n is a, c, g, or t/u
  misc_feature (634)..(635): n is a, c, g, or t/u
  misc_feature (657)..(657): n is a, c, g, or t/u
  misc_feature (707)..(707): n is a, c, g, or t/u
  misc_feature (727)..(727): n is a, c, g, or t/u
ggatgccctccttcgagaattccaggaagagattgctcggctcaaggcccagctggaaaaacggtccattgaggagaagatgaggctgctgaaggagaaagagaaaaagatggaggacctgcggcgggagaaggatgctgccgagatgctgggcgccaagatcaaggccatggagagtaagttgcttgttggaggaaaaaatatagtagatcatacgaatgaacagcagaaaatcctggagcagaaacgacaggaaattgcagagcagaaacgtcnagaaagagaaatccagcaacagatggaaagtcgagatgaggagaccttggaacttaaagagacatacagctcattgcagcaagaggtggacatcaagaccaaaaaactcaaaaagctcttctncaagcttcaggcagtgaaggctgagatccatgacctccaagaagaacacatnaaggagcgccaagagctanagcagactcagaatgagctcaccagggagctgaaactcaagcatcttattatagaaaactttatccctctggaagaaaaaagtaaaattatgaatagagccttcttttgatgaagaggaagatcattggaaactacatcctataaccagactggagaaccagcnnatgatgaaaccgccagtcttangccgtggggatattaaggagaccatttgagcccaacaccccaagaatgtnccatgatggattccgtccanaagccccgatt

SEQ ID NO: 10 - DNA, 785 bp, Homo sapiens
  misc_feature (557)..(557): n is a, c, g, or t/u
  misc_feature (629)..(629): n is a, c, g, or t/u
  misc_feature (702)..(702): n is a, c, g, or t/u
  misc_feature (740)..(740): n is a, c, g, or t/u
  misc_feature (747)..(747): n is a, c, g, or t/u
  misc_feature (754)..(754): n is a, c, g, or t/u
gtttcaccaggcaaatttttgtatttttagtacagatggggtttcaccatgttggccaggctggtcttgaagtcctaacctcaggtggtccacccacctcggcctcccaaagtgctaggattacaggcatgagtcaccatacccggccggttatctgcagttttcaattctcagatttgctacatgaatatttttagcctacagaattcagattagctttgaggaaatgtggtgtgagagacacgtgtaaccagcagaaaatcagcttaggctacccaccttagcgttttgttcttattcaaacaggcaaattcttagtaaataagaaagaagtaaagtttgatctcaagaaaagatgagggaaggctaaaaagggccctgggttcagaaagaagggttactaaaaaggagataagccgctggacaacagatctccattttgcagaatgctaagacattgcacttagtacctcctgtttcccatgggttctgatccagaaatgtgccctgggaactgagcagctgagttaaaatataactcaaggcccacctgagtngccaccttcctgaggcaccgtgccagcaaggtgcaccagtgtggcagacctggagactcactgtccccttangcttggctcatggacttagacacccacatgggaatgcttccagcctggattaagtcatttcatggggcccttnaattccagaccaaaaggcaaccaactgcacaattatgnatttctnaaaattngggcaagttcttgggctttgggctcttttac

SEQ ID NO: 11 - DNA, 1057 bp, Homo sapiens
ggaacccgtggtcctccgcttcatgattttctgccgtctcttggcaaaaatggcaaataatgatgctgttctgaagagactggagcagaagggtgcagaggcagatcaaatcattgaatatcttaagcagcaagtttctctacttaaggagaaagcaattttgcaggcaactttgagggaagagaagaaacttcgagttgaaaatgctaaactgaagaaagaaattgaagaactgaaacaagagctaattcaggcagaaattcaaaatggagtgaagcaaatagcatttccatctggtactccactgcacgctaattctatggtttctgaaaatgtgatacagtctacagcagtaacaaccgtatcttctggtaccaaagaacagataaaaggaggaacaggagacgaaaagaaagcgaaagagaaaattgaaaagaaaggagagaagaaggagaaaaaacagcaatcaatagctggaagtgccgactctaagccaatagatgtttcccgtctggatcttcgaattggttgcatcataactgctagaaaacaccctgatgcagattctttgtatgtggaagaagtagatgtcggagaaatagccccaaggacagttgtcagtggcctggtgaatcatgttcctcttgaacagatgcaaaatcggatggtgattttactttgtaacctgaaacctgcaaagatgaggggagtattatctcaagcaatggtcatgtgtgctagttcaccagagaaaattgaaatcttggctcctccaaatgggtctgttcctggagacagaattacttttgatgctttcccaggagagcctgacaaggagctgaatcctaagaagaagatttgggagcagatccagcctgatcttcacactaatgatgagtgtgtggctacatacaaaggagttccctttgaggtgaaagggaagggagtatgtagggctcaaaccatgagcaacagtggaatcaaataaaatgcttccactaccaaaagacattagagaaaaccttaaaagtaataaagagaaatatatttgtcactt

SEQ ID NO: 12 - DNA, 762 bp, Homo sapiens
  misc_feature (588)..(588): n is a, c, g, or t/u
  misc_feature (715)..(715): n is a, c, g, or t/u
  misc_feature (725)..(725): n is a, c, g, or t/u
agatggtgagtgggaacgtgagggtgatgtcggagatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacggtttgaacggttccgaacaggccagaccaccaaggccccaagtgaggccgagccggcagctgacctgatcgacatgggccctgacccagcagccaccggcaacctctcatcccagctggcaggaatgaacctgggctccagcagtgtgagagctggcctgcagtctctggaggcctctggtcgactggaagatgagtttgacatgtttgcgctgacacggggcagctcactggctgaccaacggaaagaggtaaaatacgaagccccccaagcaacagacggcctggctggagccctggacgcccggcagcagagcactggccgcgatcccagtcacccaggcctgcctcatggaggacatngagcagtggctgtccactgacgtggggaatgatgccgaaaaacctaagggggtcaccagcgaaagaatttgaccaattcctggaagaacgggcccaaagcccgcggaccgattggcccaaccttttncagccccttnacttgaaggcccccccgggtcccccaattttgggcca

SEQ ID NO: 13 - DNA, 1867 bp, Homo sapiens
gaagctcccaactcgccggcctggccacgggatggcccccaaattcccagactctgtggaggagctccgcgccgccggcaatgagagtttccgcaacggccagtacgccgaggcctccgcgctctacggccgcgcgctgcgggtgctgcaggcgcaaggttcttcagacccagaagaagaaagtgttctctactccaaccgagcagcatgtcactggaagaatggaaactgcagagactgcatcaaagattgcacttcagcactggccttggttcccttcagcattaagcccctgctgcggcgagcatctgcttatgaggctctggagaagtaccctatggcctatgttgactataagactgtgctgcagattgatgataatgtgacgtcagccgtagaaggcatcaacagaatgaccagagctctcatggactcgcttgggcctgagtggcgcctgaagctgccctcattccccttggtgcctgtgtcagctcagaagaggtggaatttcttgccttcggagaaccacaaagagatggctaaaagcaaatccaaagaaaccacagctacaaagaacagagtgccttctgctggggatgtggagaaagccagagttctgaaggaagaaggcaatgagcttgtaaagaagggaaaccataagaaagctattgagaagtacagtgaaagcctcttgtgtagtaacctggaatctgccacgtacagcaacagagcactctgctatttggtcctgaagcagtacacagaagcagtgaaggactgcacagaagccctcaagctggatggaaagaacgtgaaggcattctacagacgggctcaagcccacaaagcactcaaggactataaatccagctttgcagacatcagcaacctcctacagattgagcctaggaatggtcctgcacagaagttgcggcaggaagtgaagcagaacctacactaaaaacccaacagggcaactggaacccctgcctgaccttacccagagaagccatgggccacctgctctgtgcccgctcctgaaacccagcatgccccaagtgagctctgaagccccctcctcaatcccttgatggcctcccaccctgtaagaggctttgcttgttcaaattaaactcagtgtagtcaaacacagacatggttgttgcaccagaaaggtccccactagagctaagcgtgaagctgaagctctgtccctattcccccagcccagctagctgatcacaccaacagatcctcatcagcaaagcatttggctttgtcctgcccaagtgggctgcagactgagtgctgcccttgtagcttccccagaccccaactcactgcagttcatctgaacaacctgagctcctgggccggggtggaaggagggggataaacctaaggccctgatccaaagcagcctgttgagctggttctccagggctgcagtctctccaggtgtacagctgtccctgccctgtcctgtccttgcacagtctcctatgtctgagccccagtgccttctgttcgggccctcctttggtgggaaaggcagagccctgacccttgaatggttgtccttgactctgtgctgctgccttctgcagagaggcacctaagctgtttaaagagcccagtgattgtggctgctcctcctagaggtgggagggggcaagaggcctccttggtcagtgtccatgctttctgggcagggacttggttttttgttccaacagtggccttctccgggcttcatagttctttgtaatatgttgaagttaatttgaattgactgattttgttgaactgtgtgtttaagctgttgcattaaaaagctttcttctacatcaaaaaaaaaaaaaaaaaa

SEQ ID NO: 14 - DNA, 774 bp, Homo sapiens
  misc_feature (576)..(576): n is a, c, g, or t/u
  misc_feature (585)..(585): n is a, c, g, or t/u
  misc_feature (653)..(653): n is a, c, g, or t/u
  misc_feature (694)..(694): n is a, c, g, or t/u
  misc_feature (700)..(700): n is a, c, g, or t/u
  misc_feature (734)..(734): n is a, c, g, or t/u
  misc_feature (751)..(751): n is a, c, g, or t/u
  misc_feature (755)..(755): n is a, c, g, or t/u
  misc_feature (760)..(760): n is a, c, g, or t/u
  misc_feature (766)..(766): n is a, c, g, or t/u
accgcccgcattgccgctcccagtcccgcgctcggcacgacatgaaatcccccgacgaggtgctacgcgagggcgagttggagaagcgcagcgacagcctcttccagctatggaagaagaagcgcggggtgctcacctccgaccgcctgagcctgttccccgccagcccccgcgcgcgccccaaggagctgcgcttccactccatcctcaaggtggactgcgtggagcgcacgggcaagtacgtgtacttcaccatcgtcaccaccgaccacaaggagatcgacttccgctgcgcgggcgagagctgctggaacgcggccatcgcgctggcgctcatcgatttccagaaccgccgcgccctgcaggactttcgcagccgccaggaacgcaccgacccgccgcacccgccgaggacgccgtggctgccgcggccgccgcaccctccgagccctcggagccctccaggccatccccgcagcccaaaccccgcacgccatgagcccgccgcgggccatacgctggacgagtcggaccgaggctaggacgtggccggcgcttctccagccctgcagcaanaagaacttnccgtgcgcgcggatcctcgcttcggtgcaacgggcgccttaagttattggactatctaatatctatgnatttatttccgctgggtttttgtagtcacatattttatagncttaanatctttggttttgcattaactggggccattggcnaaataaaatactttggncagntttgntttttntaccttcc

SEQ ID NO: 15 - DNA, 725 bp, Homo sapiens
  misc_feature (95)..(95): n is a, c, g, or t/u
  misc_feature (526)..(526): n is a, c, g, or t/u
  misc_feature (616)..(616): n is a, c, g, or t/u
  misc_feature (632)..(632): n is a, c, g, or t/u
  misc_feature (660)..(660): n is a, c, g, or t/u
  misc_feature (670)..(670): n is a, c, g, or t/u
  misc_feature (687)..(687): n is a, c, g, or t/u
  misc_feature (702)..(702): n is a, c, g, or t/u
  misc_feature (706)..(706): n is a, c, g, or t/u
gcagcttcaagaacgagtgatttaagaacagccctcccatcttagcaatgtcccggggtggctggagccacggtcacttcttggtcctggtccanaactgtcggtagcgctccacatgcaagtcatcactgagctcctgctcgtactccttcctcgactggagctgagcctcacgcttccgcagcctggcccggcgctcctcaggagacagggtgtccagatctatgggcatcgccagcatgcgccgtggctccctgtagcggatgtggatggtggagccatcctgcttcaccagcagcacggggtagagtcgtgcataagcctggcggtgcacacgagtgagtgaggccctgctgctgtcagctcgccaggaggatgtgtgcaggcggcggagtgcaggtccggtggccttcacggtgctctgcctcagccggccaagcaggctgcccacggccgccattcctccttacagccccagtggcacgtggaggtggtcagtacaggccctggcgtgcaaccagcacangagcctggggctggtccaggaagggtcttcggggaaagctccctcttcctttcctgctagactggggcccgccacagtccgcttgcggangggtctgaaggaacangccggtcctgaattcccgcttgcccggngggaactaanaaccaagggacgaaggnccccgccaggaagancaanggtacctcccttggcctaa

SEQ ID NO: 16 - DNA, 469 bp, Homo sapiens
  misc_feature (13)..(13): n is a, c, g, or t/u
  misc_feature (111)..(111): n is a, c, g, or t/u
  misc_feature (120)..(120): n is a, c, g, or t/u
  misc_feature (164)..(164): n is a, c, g, or t/u
  misc_feature (194)..(194): n is a, c, g, or t/u
  misc_feature (245)..(245): n is a, c, g, or t/u
  misc_feature (344)..(344): n is a, c, g, or t/u
  misc_feature (372)..(372): n is a, c, g, or t/u
  misc_feature (436)..(436): n is a, c, g, or t/u
gtgactacaggcngatcgagattactatttgcaaaaatgatgaatgtgtgctagaagataattctcagcggaccaaatggaaagtgatcagccccacagggaacgaggcantggtgccgncagtctgcttcctcatccccccacccaataaggatgccattganatggccagcagggtcgaacaatcttatcanaaggttatggccctttggcatcagctgcatgttaacaccaaaagccttatntcttggaactatctgcgtaaagaccttgaccttgtacagacctggaacctagaaaagcttcgatcctcagcaccaggggagtgccatcagattatgaanaaccttcaggcccactatgaagactttntgcaggatagtcgagactctgtgctggtctcagtggctgatcgcttgcgcttggaagaggaggnggaagcttgtaaagcccgcttccagcacctgat

SEQ ID NO: 17 - DNA, 712 bp, Homo sapiens
  misc_feature (578)..(578): n is a, c, g, or t/u
  misc_feature (591)..(591): n is a, c, g, or t/u
  misc_feature (620)..(620): n is a, c, g, or t/u
  misc_feature (645)..(645): n is a, c, g, or t/u
  misc_feature (662)..(662): n is a, c, g, or t/u
  misc_feature (679)..(679): n is a, c, g, or t/u
gcttccaccacagaaagagggcctctgctctcagtaagcctgcttattaaggccagggcatcctgtagctcccggagctgctggtacatctggggattaatgaggtttctggctacgccctcctccaaagagaggttttcacccgtctcaggggcaatgaggccagacatgataacctgagattccagaagcactaggcctgtgtcttggtcaaggaggcccttttgcatggctttgaagatgggaaatatctccactgtgcctaggtcaatcaccccagcaactgctctgcattccttttgttctgtctggtgagccaactggctctgaagctgctgaagctgatttgcagaaccatcacaaaggtcatggtaagccttgtttagggcattcaattgctcagatatttgtttcttctctttttctgagagcttatgaccatgcttggccaagaagatctgtgatgttttaatagcttcaaaaacttgttctttctttgttgtcagctcttctgacagaacctgctgttccaaaatagctttttcaatgtctgttgattctttggtctcggatgaagnagcttttccttgngtattccctcgctagggtagacaccccancccaaaaagttctttaacccttctncacatggtccttggttncttcctctttttaacanttttttccttcctccttccaaaacgcccggaat

SEQ ID NO: 18 - DNA, 2042 bp, Homo sapiens
gcgcctgtcagggaagcggcgcgcgcgcgcgggcggcgggcgggctggggatccgccgcgcagtgccagcgccagcgccagacccgcgccccgcgctctccggcccgtcgcctgccttgggactcgcgagcccgcactcccgccctgcctgttcgctgcccgagtatggagctgctgtgttgcgaaggcacccggcacgcgccccgggccgggccggacccgcggctgctgggggaccagcgtgtcctgcagagcctgctccgcctggaggagcgctacgtaccccgcgcctcctacttccagtgcgtgcagcgggagatcaagccgcacatgcggaagatgctggcttactggatgctggaggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagcctctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgccccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacataatgggggcctggccatccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaataaaactggctttgg

SEQ ID NO: 19 - DNA, 617 bp, Homo sapiens
  misc_feature (176)..(176): n is a, c, g, or t/u
  misc_feature (251)..(251): n is a, c, g, or t/u
  misc_feature (389)..(389): n is a, c, g, or t/u
  misc_feature (404)..(404): n is a, c, g, or t/u
  misc_feature (437)..(437): n is a, c, g, or t/u
  misc_feature (475)..(475): n is a, c, g, or t/u
  misc_feature (509)..(509): n is a, c, g, or t/u
  misc_feature (512)..(512): n is a, c, g, or t/u
ttttgcttgatcctcacttgtacttattagggcccaccctcacatttagctgaaggtcccagcacactctcacagtgtcagggagaacagtctcagggatgtctgttgctctgaaggtcacttgcccctcttgctgcggcccttcctggagggcaacttcccactgccccccgaanagcagggctcgaggccgaggccatggcgatgttgatctgtccctcctggatttcctgccgggtctcggcaggcanatggttgatcttctgctgtgtctccaggtagaacatgacgtcacgcagctgctcctggatctcggtgatctgcagatctttttggtcacaggtctccttcagcaccctctcctcctcttttagcttgttctgcaggangacttggttggctcncaaacacttgttcatttcctgctcctctttganctcgttggtgagtttggccacttttgtgtttagctgantgcactttctttccacagactgcttttcttttanganatcatttagtttgtgctctaaattatcacacttctcaattgtttctttaaacttggtcttcatgttgttaatttcctctgctgtgtccttctctatccgaaacta

SEQ ID NO: 20 - DNA, 805 bp, Homo sapiens
  misc_feature (669)..(669): n is a, c, g, or t/u
  misc_feature (680)..(680): n is a, c, g, or t/u
  misc_feature (683)..(683): n is a, c, g, or t/u
  misc_feature (755)..(755): n is a, c, g, or t/u
  misc_feature (783)..(783): n is a, c, g, or t/u
ctcaatacaagggcgccgcgagcgaggccggccgcgccatgcacctgatgaagaagcgggagaagcagcgcgagcagatggagcagatgaagcagcgcatcgcggaggagaacatcatgaaatccaacattgacaagaagttctctgcgcactacgacgcggtggaggcagagctcaagtccagcaccgtgggtctcgtgaccctgaatgacatgaaggccaagcaggaggctctggtgaaggagcgggagaagcagctggccaagaaggagcagtccaaggagctgcagatgaagctggagaagcttcgagagaaggagcgtaagaaggaagccaagcggaagatctccagcctgtccttcaccctggaggaggaagaagagggaggcgaggaggaagaggaggcggccatgtatgaggaggagatggaaagggaagagatcaccacgaagaagagaaaactggggaagaacccagacgttgacacaagcttcttgcctgatcgagaccgtgaggaggaggagaatcggctttgggaagagctgcggcaggagtgggaagccaagcaggagaagatcaagagtgaggagatcgagatcaccttcagctactgggatggctctgggcaccggccggacagtcaagatgagaaagggcaacaccatgcancagttctgcanaangcgctcgagatccttcggaaagactttcagtgagctgaggtccccaagggtggagcacttatgtacattaanggaggactttgatcattccctcaccatnacagtttttaccaattcttcgt

SEQ ID NO: 21 - DNA, 668 bp, Homo sapiens
  misc_feature (450)..(450): n is a, c, g, or t/u
  misc_feature (501)..(501): n is a, c, g, or t/u
  misc_feature (549)..(549): n is a, c, g, or t/u
  misc_feature (608)..(608): n is a, c, g, or t/u
  misc_feature (624)..(624): n is a, c, g, or t/u
  misc_feature (633)..(633): n is a, c, g, or t/u
  misc_feature (664)..(664): n is a, c, g, or t/u
ggtttctcacaatgcaggcgctccagctctgacacgtgcacttctttattggaaaagaataaagcagtcactgatgtggcaggggcaggacacgagcagctgccgtcctcctcccagcgtgcctggcatggtcgcaggggagcgggtgcctggagtcccggtgacaccacggggcacactgagggagctgaggagccggggccgcgcagcctcctggatgctcagcggatcgtgtacttgtcccacttcttttcagggtcgtagggttcccagcggctggcgggaaagatgtgcttgttcttctcgtaccaagctcctcagcaccaccttgcctgcatgggactcatccttctccacagtggcgtcactgagcaaccgcacatcgtcatgaacatcaaagttgaaaaagtggccactcttccccgtgccttggtgacgatgaagtcgtanaagctgtgatggtgagggatgatcaagtcctccttgatgtacatgagctgnttcacccctggggacctcagctcactgaagtctttcccaaggatcttnagcgccttctgcaggaactgttcatggtgttgcctttctcatcttgactgtccgccggnccaaaccatcccgtancttaaaggngactcgatctcctaattttgacttctcctgnttgg

SEQ ID NO: 22 - DNA, 968 bp, Homo sapiens
  misc_feature (847)..(847): n is a, c, g, or t/u
  misc_feature (873)..(873): n is a, c, g, or t/u
  misc_feature (881)..(881): n is a, c, g, or t/u
  misc_feature (889)..(889): n is a, c, g, or t/u
tgcacctcctcaagaagcgcgaaaggcagcgggagcagatggaggtgctgaagcagcgcatcgccgaggagaccatcctcaagtcgcaggtggacaagaggttctcggcgcattacgacgccgtggaggccgagctgaagtccagcacggtgggcctggtgaccctgaacgacatgaaggcccggcaggaggccctggtcagggagcgcgagcggcagctggccaagcgccagcacctggaggagcagcggctgcagcaggagcggcagcgggagcaggagcagcggcgcgagcgcaagcgtaagatctcctgcctgtcctttgcactagacgacctcgatgaccaggccgacgcggccgaggccaggcgcgccggaaacctgggcaagaaccccgacgtggacaccagcttcctgccagaccgcgaccgcgaggaggaggagaaccggctccgagaggagctgcgccaagagtgggaggcgcagcgcgagaaagtgaaggacgaggagatggaggtcaccttcagctactgggacggctcgggccaccggcgcacggtgcgggtgcgcaagggcaacacggtgcagcagttcctgaagaagcgctgcaggggctgcgcaaggacttcctggagctgcgctccgccggcgtggagcagctcatgttcatcaaggaggacctcatcctgccgcactaccacaccttctacgacttcatcatcgccagggccaggggcaagagcgggccgctcttcaacttcgatgtgcacgatgacgtgccgccttgttaagcgacgccaccatggagaaaggacgaattcgcacgccgggcaaaggtgggtgctgcncaacttgtaccaagaagaaccaagcncatttttncccgccangccgctgggaaggcctattgacccccgaagaagaaaatggggacaaagttccccattccggttacaacccggccttgcc

SEQ ID NO: 23 - DNA, 713 bp, Homo sapiens
  misc_feature (540)..(540): n is a, c, g, or t/u
  misc_feature (650)..(650): n is a, c, g, or t/u
  misc_feature (667)..(667): n is a, c, g, or t/u
  misc_feature (682)..(682): n is a, c, g, or t/u
  misc_feature (691)..(691): n is a, c, g, or t/u
aataacaacagaaacatttattaagagctaagcgttttacaaatattaattcacttaatactcacatcaatcttataaagtaagtgctcttgttatttccttttacaggtgaccaaactgaggcatgggggtttaataagcttacccaaaactacacagcaaggaggaggctgtgtcgggaatcaaactcagtcactgtggcccccaagtccatgctcataaccaccaggtaaaaaatgtgcctcctattctaatttctgtctgacagtgggcccagtcatggtttcaatacagctcagcagagcaatgcagcaaatccaggtggcaacactaaaatactcagaaaagaccaaccaaccaaccaaagcataacatcagcaatagcacaaccaatgtgaatcatgagaaccctctgtctttattaaatttgggggaagaaatcaaggtcacgaaatcaagtgactggtgatggggcctagaaatgagtgtctccccccacccccggtttccgctctggcaggcgggtgttagccggatggngtacttgtcccacttcttctcggggtcataggcctcccagcggctggcggggaagatgtgcttggtcttcttcgtaccagctgcgcaggaccaccttgcccgcgtgcganttgtccttctccatggnggcgtcgctgaacangcgcacgtnatcgggcacattcgaagctgaa

SEQ ID NO: 24 - DNA, 811 bp, Homo sapiens
  misc_feature (695)..(695): n is a, c, g, or t/u
  misc_feature (758)..(758): n is a, c, g, or t/u
  misc_feature (766)..(766): n is a, c, g, or t/u
  misc_feature (784)..(784): n is a, c, g, or t/u
  misc_feature (797)..(797): n is a, c, g, or t/u
gttgttttcttttcacggatcctgccctttcttcccgaaaagaagacagccttgggtcgcgattgtggggcttcgaagagtccagcagtgggaatttctagaatttggaatcgagtgcattttctgacatttgagtacagtacccaggggttcttggagaagaacctggtcccagaggagcttgactgaccataaaaatgagtactgcagatgcacttgatgatgaaaacacatttaaaatattagttgcaacagatattcatcttggatttatggagaaagatgcagtcagaggaaatgatacgtttgtaacactcgatgaaattttaagacttgcccaggaaaatgaagtggattttattttgttaggtggtgatctttttcatgaaaataagccctcaaggaaaacattacatacctgcctcgagttattaagaaaatattgtatgggtgatcggcctgtccagtttgaaattctcagtgatcagtcagtcaactttggttttagtaagtttccatgggtgaactatcaagatggcaacctcaacatttcaattccagtgtttagtattcatggcaatcatgacgatcccacaggggcagatgcactttgtgccttggacattttaagttgtgctggatttgtaaatcactttgggaccgttcaatggctgtgggagaagatagacatttantccgggttttgcttcaaaaaaggaagccccaaaggaatggcgcttttattgggtttaaggaanccattccnagaatgaaaaggcttctntcgaaaggtttgncaattaaaaaaagt

SEQ ID NO: 25 - DNA, 782 bp, Homo sapiens
  misc_feature (2)..(2): n is a, c, g, or t/u
  misc_feature (13)..(13): n is a, c, g, or t/u
  misc_feature (18)..(18): n is a, c, g, or t/u
  misc_feature (48)..(48): n is a, c, g, or t/u
  misc_feature (62)..(62): n is a, c, g, or t/u
  misc_feature (88)..(88): n is a, c, g, or t/u
  misc_feature (110)..(110): n is a, c, g, or t/u
  misc_feature (114)..(114): n is a, c, g, or t/u
  misc_feature (125)..(125): n is a, c, g, or t/u
  misc_feature (130)..(132): n is a, c, g, or t/u
  misc_feature (143)..(143): n is a, c, g, or t/u
  misc_feature (181)..(181): n is a, c, g, or t/u
  misc_feature (219)..(219): n is a, c, g, or t/u
  misc_feature (227)..(227): n is a, c, g, or t/u
  misc_feature (234)..(234): n is a, c, g, or t/u
  misc_feature (345)..(345): n is a, c, g, or t/u
  misc_feature (374)..(374): n is a, c, g, or t/u
  misc_feature (404)..(404): n is a, c, g, or t/u
  misc_feature (406)..(406): n is a, c, g, or t/u
  misc_feature (426)..(426): n is a, c, g, or t/u
  misc_feature (428)..(428): n is a, c, g, or t/u
  misc_feature (433)..(433): n is a, c, g, or t/u
  misc_feature (443)..(443): n is a, c, g, or t/u
  misc_feature (469)..(469): n is a, c, g, or t/u
  misc_feature (479)..(479): n is a, c, g, or t/u
  misc_feature (512)..(512): n is a, c, g, or t/u
  misc_feature (542)..(542): n is a, c, g, or t/u
  misc_feature (558)..(559): n is a, c, g, or t/u
  misc_feature (571)..(571): n is a, c, g, or t/u
  misc_feature (589)..(589): n is a, c, g, or t/u
  misc_feature (595)..(595): n is a, c, g, or t/u
  misc_feature (605)..(605): n is a, c, g, or t/u
  misc_feature (650)..(650): n is a, c, g, or t/u
  misc_feature (657)..(657): n is a, c, g, or t/u
  misc_feature (662)..(662): n is a, c, g, or t/u
  misc_feature (668)..(668): n is a, c, g, or t/u
  misc_feature (679)..(679): n is a, c, g, or t/u
  misc_feature (684)..(684): n is a, c, g, or t/u
  misc_feature (689)..(689): n is a, c, g, or t/u
  misc_feature (704)..(704): n is a, c, g, or t/u
  misc_feature (715)..(716): n is a, c, g, or t/u
  misc_feature (725)..(726): n is a, c, g, or t/u
  misc_feature (732)..(732): n is a, c, g, or t/u
  misc_feature (736)..(737): n is a, c, g, or t/u
  misc_feature (754)..(754): n is a, c, g, or t/u
  misc_feature (776)..(776): n is a, c, g, or t/u
anaaatgtaaaanggtanctttattttaatctttactcaagagtgatnttgaaacaaagctnttactacaacaaccaggttaaaaaancaaggggaatcaatgctattgnatgnctgtgaactanaaatnnnttacttatggngttatgctcaggaaacaatacttaaaatcttaaactgnaaactcttaccttgtaacattttcatttttcctgtatnttgcatgnttctcantgccattaaatatattatcttctatttcttcttaaagaactagtgttcataaaaggatcatcatcatcatcctcacttgattcaaaatcaacccctttcgatacttgactntgggacatgattttgctggatgatgtgcnggaccacctttgatctgcctttgaaggggnangaaaaatgtcttcttccacntntgatncatctacctnaatcacctctgaataatccttactantgacatttcnggaaggctgctggattgtagatttaaaggcatngtataatagacatatttctagatgctgacncagcagtctttgagtnnctgctcgggtanaagtctccagaccagtgnctgctnttcctctttnaggacccttctctccaagctgaattgtggcctcttacaccttttngactctnccctnggcctnttcctttggtnggttnctgcntgaaatgctatcctnagagcccttannccaatctgnnctggcnaaanncatacctcataaagggnttttaggcacttaaaggccatnaacccg

SEQ ID NO: 26 - DNA, 801 bp, Homo sapiens
  misc_feature (642)..(642): n is a, c, g, or t/u
  misc_feature (709)..(709): n is a, c, g, or t/u
  misc_feature (739)..(739): n is a, c, g, or t/u
ccgaggacggggcggacgaggccgaggcagagatcatccagctgctgaagcgagccaagttgagcattatgaaagatgagccagaagaggctgagttaattttgcatgacgctcttcgtctcgcctatcagactgataacaagaaggccatcacttacacttatgatttgatggccaacttagcatttatacggggtcagcttgaaaatgctgaacaactttttaaagcaacaatgagttacctccttggagggggcatgaagcaggaggacaatgcaataattgaaatttccctaaagctggccagtatctatgctgcgcagaacagacaggaatttgctgttgctggctatgaattctgcatttcaactctagaggaaaaaattgaaagagaaaaggaattagcagaagacattatgtcagtggaagagaaagccaatacccacctcctcttgggcatgtgcttagacgcctgtgctcgctaccttctgttctccaagcagcccgtcacaggcacaaaggatgtatgaaaaagctctgcagatttctgaagaaatacaaggagaaagacacccacagaccattgtgctgatgagtgacctggctactaccctggatgcacagggccccttttgatgaggnctatatttatatgccaagggcattcagatctggcaagacagataaatcatcctgagctacacatggnactcagtaatctaactgcagttttgatgcncagagaaccgattttccccaagccaaaggagaatcttacccggaaagcccttgaagccagcc

SEQ ID NO: 27 - DNA, 814 bp, Homo sapiens
  misc_feature (366)..(366): n is a, c, g, or t/u
  misc_feature (399)..(399): n is a, c, g, or t/u
  misc_feature (519)..(519): n is a, c, g, or t/u
  misc_feature (565)..(565): n is a, c, g, or t/u
  misc_feature (619)..(619): n is a, c, g, or t/u
  misc_feature (628)..(628): n is a, c, g, or t/u
  misc_feature (636)..(636): n is a, c, g, or t/u
  misc_feature (681)..(681): n is a, c, g, or t/u
  misc_feature (719)..(719): n is a, c, g, or t/u
  misc_feature (727)..(727): n is a, c, g, or t/u
  misc_feature (729)..(729): n is a, c, g, or t/u
  misc_feature (744)..(744): n is a, c, g, or t/u
  misc_feature (755)..(755): n is a, c, g, or t/u
  misc_feature (763)..(763): n is a, c, g, or t/u
  misc_feature (790)..(790): n is a, c, g, or t/u
  misc_feature (803)..(803): n is a, c, g, or t/u
gttgtgtagtctcatttattatgaagattcttccagtatgtacatacgaaccaaaagtatcagtttatcagtcccactcacatcccacccccacaggcataccaacagggtcaatcttccttcatggtacctagaaaaactgtctttttccttaggtaaatggctaaaaatgtattcatgactgctgcagtaagagcatccacctatgtatctttacatactttgagacagtgtgataaagctctttcagcacagcagtctattcattcaaagtcatctaaccaaataccttcccccacagctaagaaagaatcccagtgtttccctagtttagagatgaagatactgaaattgcaaaagcaaaanggctaggactaagatccaggtcagtagttcagntataccagcagtacacattagaattacgaagagttttaaaatatacctgtaggggcctattctgactcagaacagcctgggctgtgtgtccttaaagagtacttgagatgactcagttgngtgactaaggctgcaaaggaagtagagtgttcagataacacagacnaaaggttacatcattcttagtttttagttttatataaacacccccatttttagntttaatatnaccagatnaatatgggtcacttttatttaaaattcaaatgggtgctatactgncaccgtgcctaatccccacttttacaactttcatgctnggatgctngnaaccaaacttagganatttctcctcnttttaggnattaaaattccccctttggggctttanggaaaaccggacntttaaggaacc

SEQ ID NO: 28 - DNA, 3474 bp, Homo sapiens
gcgcgccggcggctcgggcagaggggcgggagctgaggcgggagcggacaggctggtgggcgagcgagaggcgcggaatggtggactaccacgcggcgaaccagtcgtaccagtacggccccagcagcgcggcaatggcttggcggcgggggagcatgggcgactacatggcccaggaggacgactgggaccgggacctgctgctggacccggcctgggagaagcagcagcgcaagaccttcacggcatggagcaactcccacctgcggaaggcaggcacacagatcgagaacattgatgaggacttccgagacgggctcaagctcatgctgctcctggaggtcatatcaggggagcggttacctaagccggagcgggggaagatgagagtgcacaaaatcaacaatgtgaacaaagcgctggactttattgccagcaaagggatcaagctggacttccatcgggcagaagagattgtggacggcaacgcaaagatgaccctgggaatgatctggaccatcatccttaggttcgccatccaggacatctccgtggaagagacctcggccaaggaagggctccttctctggtgccagagaaagacagccccatataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgaaactgccgccaaccggatctgtaaggtgctggctgtcaaccaagagaactgcagcacctcgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacagcgtgcagaccaagctgcgcctcagcaaccggcccgccttcatgccctccgagggcaagatggtctcggacatcaacaatggctggcagcacttggagcaggctgagaagggctacgaggagtggctgctgaatgagattcgcaggctggagcggctcgaccacctggcagagaagttccggcagaaagcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgcctccgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcatcgaccagctgcacctggaatacgccaagcccgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctgcatccacaaggaggccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagcagtccaacgagcacctgcgccgccagttcgccagccaggccaatgttgtggggccctggatccagaccaagatggaggagatcgcgatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatccttacccgcgacgccaagggcatcagccaggagcagatgcaggagttccgggcgtccttcaaccacttcgacaaggatcatggcggggcgctggggcgaggagttcaaggcctgcctcatcagcctgggctacgacgtggagaacgaccggcaggtgaggccgagttcaaccgcatcatgagcctggtcgaccccaaccatagcggccttgttaccttccaagccttcatcgacttcatgtcgcgggagaccaccgacaccgacacggctgaccaggtaatcacttccttcaaggtcctagcaggggacaagaacttcatcacagctgaggagctgcggagagagctgccccccgaccaggccgagtactgcatcgcccgcatggcgccataccagggccctgacggcgtgcgcggtgccctcgactacaagtccttctccacggccttgtatggcgagagcgacctgtgaggccccagagacctgacccaacacccccgacgcctccaggagcctggcagccccacagtcccattcctccactctgtatctatgcaaagcactctctctgcagtctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccagggaactgcctgggccatgcgaggggccagcagagggcgccaccacctgacggctgggacccacccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcagattttctaagaaccaaaaaaa

SEQ ID NO: 29 - DNA, 5823 bp, Homo sapiens
ggtagctgggtgcagacgccgtggcgctggagacccaaacatggcaaacctggaagaaagcttcccccgaggaggtacaagaaagatccacaaaccagagaaagctttccagcagtcagttgaacaagacaacttatttgatatttctactgaagagggatccaccaaaagaaaaaagagccagaaggggccagcaaaaacaaaaaagttgaaaatcgaaaagagagaaagcagcaagtccgcaagagagaagtttgaaatccttagtgttgagtccctgtgtgagggaatgcgtattttgggttgcgtgaaagaggtgaatgaactggaactggtgattagtctccccaatggcctccagggctttgtgcaagtcactgaaatctgtgatgcctacaccaaaaagctgaatgagcaggtgacacaagaacaacctctgaaggacctacttcacttgcctgaacttttctcacctggaatgctggtaagatgtgtggtgagcagtctgggcatcacagacaggggcaagaagagtgtcaagctgtctctgaaccccaaaaatgtcaacagagtgctgagtgctgaggccctgaagcctggcatgctacttacaggtaccgtatccagcctggaagaccatggctacctagtggacattggtgttgatgggaccagagcttttctgccactgctgaaagcccaggagtacatcagacagaagaacaaaggtgctaaactaaaggtgggtcagtacctgaactgcattgttgaaaaggtgaaaggcaacggaggagttgttagtctgtctgttggtcactcagaggtttctacggccattgctactgaacagcagagctggaaccttaataacttgctaccaggactggtggtcaaagctcaggtacagaaggtgactccatttggccttacgctaaacttcctcacattcttcacgggcgtggttgactttatgcacctggatcccaagaaagctggaacatatttctcaaatcaggcagtgagggcctgcatcctttgcgtccatcctcgaaccagagttgtgcacctgagcctgcgccccatcttcctacagcctggacgcccactcacccgactctcttgccagaaccttggagcagtgctggatgatgttcctgtccagggttttttcaaaaaggctggggccacctttaggctgaaggatggggttctggcctatgcccggctcagccatctctctgattctaagaacgtcttcaatcctgaggccttcaagccagggaacactcacaagtgtagaattattgactacagccaaatggatgaactggccttgctctctctacgaacgtctattattgaagctcagtaccttagatatcatgacatcgaacctggggcagtggtaaagggcacagtgctaaccataaagtcatatgggatgctggtgaaggtgggcgagcagatgaggggcctggtacctcccatgcacctggctgacatcctgatgaagaatccggagaagaagtaccacatcggggatgaggtcaagtgccgggttttgctttgtgaccctgaagccaagaagctgatgatgaccctgaaaaaaaccctgattgagtccaaactacctgtcattacctgctatgccgatgccaagcctggtctgcagacacatggcttcatcatcagggtcaaggactatggctgcattgtgaagttctacaacaatgtgcagggactggtgcccaagcatgagctcagtactgagtatatccctgacccggagagagttttttacactggccaggtggtgaaggttgtcgtattgaactgtgagccatccaaagagaggatgctcttatccttcaagctgtcgagtgatccagagccaaagaaagagcctgcaggacacagtcagaagaaaggaaaagccattaacattgggcagttggtagatgtgaaggttttagagaagaccaaagatgggctggaggtggctgtcctgccccacaacatccgtgctttcctccccacatctcatctgtcggaccacgttgccaacggcccattgttacatcattggctccaggcaggtgacatccttcaccgagtcctgtgtctgagccagagcgaggggcgtgttcttctttgcaggaagccagccttggtctccacagtagaaggtggccaggatcccaagaacttctcagaaatccatcctggaatgctgctcattggttttgtgaagagcatcaaggactatggcgtgttcatccagttcccctcaggtcttagcggactggccccaaaagctatcatgagtgacaaatttgtgacctccacaagtgaccactttgttgagggccagacagtagcggcaaaggtgaccaatgtggatgaggagaagcagcggatgctgctgtcactgcggctgtcggactgtggtctgggggacttggctatcaccagcctcctcctcctgaatcagtgcctggaggagctgcagggcgtgcgcagccttatgagcaaccgagactctgtgttgatccagacgctggccgagatgaccccaggaatgttccttgacctagtggtgcaggaggtgttggaagatggctctgtggtattcagtgggggtccagtgcccgacctggtcctgaaagccagcagataccatcgcgcagggcaggaggtggaatctgggcagaaaaagaaggttgttatcttaaatgttgatcttttgaagttggaagtgcacgtttcccttcaccaggacttggtgaatagaaaagctagaaagctgaggaaaggcagcgaacaccaggcgattgtgcagcacttggagaagtcctttgccattgcctccttggtagagacgggccacctggcagctttctccctgacctctcacctcaacgacaccttccgctttgactcagagaaattgcaggtgggacagggtgtctccctaaccctcaagaccacagaaccaggagtgactggccttcttttggctgtggaggggccggctgccaagaggaccatgaggccgacccagaaggactctgagacagttgatgaggatgaagaagtggatccagctctgactgtagggaccataaagaagcacaccctctccatcggggacatggtcacagggactgtcaagtccattaagcctacccatgtggttgtgactctggaagatggcattattggctgtatccatgcctcccacattctagatgatgttccagagggcacctctcctactaccaagctgaaggttgggaagacggtcactgcccgagtgattggcgggcgagacatgaagacattcaagtatctcccaataagtcaccccagattcgttcgaaccatcccggagctgagtgttcggccaagtgagctggaggatggccacactgctcttaacactcactctgttagccccatggagaagattaaacagtaccaggccggccagactgttacttgcttcttaaagaaatacaatgtggtgaagaaatggcttgaggtggagattgccccagacatccgggggagaattcccttattgctcacttctctgagcttcaaggttctgaagcatccagataagaagttccgggttggccaggccctgagggccaccgttgttggcccagattcctccaagaccttcttatgtctgtccctcacaggtcctcacaagcttgaggaaggggaagtggccatgggccgagtggtgaaggtgactcccaacgaggggctgaccgtctccttcccctttgggaagataggaacagtcagtatatttcacatgagtgactcctactccgagacgcccctggaagacttcgtcccccagaaggttgtcagatgttacatcctgtccactgcagacaacgtattgactttgtcgctgcgatcatccagaacaaacccggagacgaaaagcaaagtagaagatccagagattaactccatccaggacattaaggaagggcagcttctgaggggctatgtagggtccatccagccacacggtgtgttctttcgccttggcccctccgttgtgggtttggctcggtactcccatgtctcccagcacagcccgtccaagaaagccctttataacaaacacctccctgaagggaagctgctcacagccagggtcctacgccttaaccaccagaagaacctggtagagctgtctttcctccccggagacactgggaagccagacgtgctttctgcttccttggaagggcaacttacaaagcaagaggagaggaaaacagaggctgaggagagagaccaaaaaggggaaaagaaaaatcagaaaaggaacgagaagaagaaccagaaggggcaggaggaggtggagatgcccagcaaggagaagcaacagccccagaagccacaggcgcagaagcggggcgggcgggagtgccgggagtctgggagtgagcaggaaagagtgagcaagaagccaaagaaagccggcctgtcagaggaggacgacagccttgtggacgtgtactatcgggagggaaaagaggaggcagaagagacgaatgtgctgcccaaggagaagcaaaccaagccagcagaagcgccccggctgcagctgtcttcaggcttcgcttggaatgtgggactagactctctgaccccggccttgccacctctagcagagagctcagacagcgaggaggatgagaagccacaccaagccacgataaagaaaagcaagaaagaaagggagttggagaagcagaaggcagagaaggaactgtcccgcattgaggaggcgctgatggatcctgggcggcagccagagtccgcggatgattttgaccgactggtgctgagctcccccaacagctccattctgtggctgcagtacatggctttccacctgcaggccacggagatcgagaaggcccgtgccgtggctgagagggcccttaagaccatctccttcagagaggagcaggagaagctgaacgtgtgggtggctctgctgaacctggagaacatgtacggctctcaggagtccctgaccaaggtctttgagcgagccgtgcagtacaacgagcctctcaaagtctttctccacctggctgacatctacgccaagtcagagaaattccaggaagctggtgaactctacaaccggatgctgaagcgtttccggcaggagaaagctgtgtggatcaaatacggcgccttccttctgcggaggagccaggctgcagccagtcaccgcgtgctgcagcgagccctggagtgcctgcctagcaaggagcatgtggatgtcattgccaagtttgcccagcttgagtttcagctgggggatgcagagcgggccaaagccatttttgagaacacgctgagcacctacccaaagcgcacagatgtctggtcggtctatatcgacatgaccatcaagcacggcagccagaaggacgtccgggacatctttgagcgggtcattcatctgagcttggcccccaagagaatgaagttcttcttcaagcgctacctggactacgagaagcagcatggcactgagaaggatgtgcaggcagtcaaggccaaggccctggagtatgtggaggccaagagctcagtgctagaggactagtggcaggctggctctgtgggacactgtcaacaatgggccagcccggccccgcctcgagtgcctgggcactcggaaaactgttacctcaggactctatttaaatgctgctttttctgcagcacgcttggggaaatcctgtcaggatgaaaaggaagttgagatttttt

SEQ ID NO: 30 - DNA, 1375 bp, Homo sapiens
tcgaattccggaagccgctcccgacaccctttgcctggctctgtccatattagttcccaggcggccgtcgcgttccagcagcggcacgcagcgcaggcggagcggcagcggggcctcggctctatagagccgagccgctggtacccgcccggtaccgcgcgagccagtgcccctggatcttgcctctgctccgacgccgttccccaccagttagcgacagcgcccgcccctctgaggagacacgaaggtggttccccagccgctcaaatttccggaccaccgcgctttcccctcctcagcctgggctgtgctctctctagaatcctcgggcccccactttcttcccaaactcatcctaaatctctcacacacgcgagtgttcccagccctcaagccagctgctcctcctccgttcattttctgcccctcttcgcaaagcacccccgggatcatcctccgagggcgactttttgagaaatctcggtggagtagtggaccagagcaggggagtttttaaaagccggggcgcgagaaacaggaaggtactatggcttcctcgtctggcaacgatgatgatctcactatccccagagctgctatcaataaaatgatcaaagagactcttcctaatgtccgggtggccaacgatgctcgagagctggtggtgaactgctgcactgaattcattcaccttatatcttctgaagccaatgagatttgtaacaaatcggaaaagaagaccatctcaccagagcatgtcatacaagcactagaaagtttgggatttggctcttacatcagtgaagtaaaagaagtcttgcaagagtgtaaaacagtagcattaaaaagaagaaaggccagttctcgtttggaaaaccttggcattcctgaagaagagttattgagacagcaacaagaattatttgcaaaagctagacagcaacaagcagaattggcccaacaggaatggcttcaaatgcagcaagctgcccaacaagcccagcttgctgctgcctcagccagtgcatctaatcaggcgggatcttctcaggatgaagaagatgatgatgatatctgaaattcaccagctgagtttctatttcttctataaatgtttttccctgcacaacaaaaacagtgaaagaaatgcttatctgtaattttgtatgcatcttggtggacttgtcattggtattctagagatgtctgctataagtttcatctgttgtgtgctatacatgtaaaaactgtctctttgaactattgaaaatttaaggttcagtataatatcaattttgaatttttcctggtgtttatgaaattttagatagcagcaagtcttcgtttgatcataaacagtgtacagataactcaa

SEQ ID NO: 31 - DNA, 749 bp, Homo sapiens
  misc_feature (558)..(558): n is a, c, g, or t/u
  misc_feature (625)..(625): n is a, c, g, or t/u
  misc_feature (675)..(675): n is a, c, g, or t/u
  misc_feature (706)..(706): n is a, c, g, or t/u
  misc_feature (740)..(740): n is a, c, g, or t/u
ataaaacacatcacaattttattgcttgaagaatacagcatatgaaatcacaagaatgtcaaaatgaaaagtcactaggcttcaaacgtataatacattatcagatgcagtaaaatattaacctgaactctgcatcagaaaaaaaaaaaaaaggtgtggaaaatatctaagttgtttacttaagaaacagatatacttaaaatagaaagtataaggatgttacagtacaaattagaaaagccaacacgtattaacttatcgttctagactagactacctttggtacttaaactttttaaaaaacaatttcttctatctcatccaaatgcacttcatgggtatgacatccatgaagtaacttcaacttaaaacattcagcaaaattaaccttttcacttcatgggggaagtatatttaataaatgtataacaatatttcccttttactaaaactgcaaaatatgatcattaagaaacctaacagttataaaactttacttacttagctctccaattaaaattggaatcctgggagccacaatctatttttgggcttggngaatacataagtttaaaagatttgggcaactgacataggaatttaattacttaatactatcttaagnggacttttcctttctggttcccaaattttgaccattatgccattttcttnaacatcctggattcctataatcccctaccanactggatttattagaacccaatttaaagcttctnttaacaagc

SEQ ID NO: 32 - DNA, 1756 bp, Homo sapiens
tcgggcgcagccgcgaagatgccgttggaactgacgcagagccgagtgcagaagatctgggtgcccgtggaccacaggccctcgttgcccagatcctgtgggccaaagctgaccaactcccccaccgtcatcgtcatggtgggcctccccgcccggggcaagacctacatctccaagaagctgactcgctacctcaactggattggcgtccccacaaaagtgttcaacgtcggggagtatcgccgggaggctgtgaagcagtacagctcctacaacttcttccgccccgacaatgaggaagccatgaaagtccggaagcaatgtgccttagctgccttgagagatgtcaaaagctacctggcgaaagaagggggacaaattgcggttttcgatgccaccaatactactagagagaggagacacatgatccttcattttgccaaagaaaatgactttaaagcgtttttcatcgagtcggtgtgcgacgaccctacagttgtggcctccaatatcatggaagttaaaatctccagcccggattacaaagactgcaactcggcagaagccatggacgacttcatgaagaggatcagttgctatgaagccagctaccagcccctcgaccccgacaaatgcgacagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcgggcgtctgtgaggagctgacctacgaggagatcagggacacctaccctgaggagtatgcgctgcgggagcaggacaagtactattaccgctaccccaccggggagtcctaccaggacctggtccagcgcttggagccagtgatcatggagctggagcggcaggagaatgtgctggtcatctgccaccaggccgtcctgcgctgcctgcttgcctacttcctggataagagtgcagaggagatgccctacctgaaatgccctcttcacaccgtcctgaaactgacgcctgtcgcttatggctgccgtgtggaatccatctacctgaacgtggagtccgtctgcacacaccgggagaggtcagaggatgcaaagaagggacctaacccgctcatgagacgcaatagtgtcaccccgctagccagccccgaacccaccaaaaagcctcgcatcaacagctttgaggagcatgtggcctccacctcggccgccctgcccagctgcctgcccccggaggtgcccacgcagctgcctggacaaaacatgaaaggctcccggagcagcgctgactcctccaggaaacactgaggcagacgtgtcggttccattccatttccatttctgcagcttagcttgtgtcctgccctccgcccgaggcaaaacgtatcctgaggacttcttccggagagggtggggtggagcagcgggggagccttggccgaagagaaccatgcttggcaccgtctgtgtcccctcggccgct

SEQ ID NO: 33 - DNA, 771 bp, Homo sapiens
  misc_feature (156)..(156): n is a, c, g, or t/u
  misc_feature (229)..(229): n is a, c, g, or t/u
  misc_feature (318)..(318): n is a, c, g, or t/u
  misc_feature (383)..(383): n is a, c, g, or t/u
  misc_feature (396)..(396): n is a, c, g, or t/u
  misc_feature (525)..(525): n is a, c, g, or t/u
  misc_feature (592)..(592): n is a, c, g, or t/u
  misc_feature (609)..(609): n is a, c, g, or t/u
  misc_feature (629)..(629): n is a, c, g, or t/u
  misc_feature (661)..(661): n is a, c, g, or t/u
  misc_feature (673)..(673): n is a, c, g, or t/u
  misc_feature (709)..(709): n is a, c, g, or t/u
  misc_feature (721)..(721): n is a, c, g, or t/u
  misc_feature (744)..(744): n is a, c, g, or t/u
  misc_feature (748)..(748): n is a, c, g, or t/u
gaatatctcatgtaatttattgaacattgtactgaaagtgaaaaacagaatggttgtatgggaactcgaagcactatttccacttctacaaaatgcgtatctctcttgcatcattgtaaagtggaagtgtcataaactacccatcatccattgganacctctgtattttacacaactgacactgacctgggaaatcccacataaccacagcataagggaagcttctcanagtcctcagcagctcaggttaattggtctctttcagccaggtatcattaggagccgcttgccgcaaagccagaaaggtgaggaagcganaccagtctgggctccgggatgcttggtgcagccccgggtccactcctggatgccacggtcacctntctgggtatccanagaatgctctgcccttcagggggctggactggtggctcagggtcccttccaggaattccactctttaactcttgtccaggcagctgcgtgggcacctccgggggcaggcagctgggcagggcggccgangtggaggcccatgctcctcaaagctgttgatgccaggcttttttggtgggttcggggcttggctaancggggtgacactattgncgtctcatgaaccgggttanggcccttctttgcatcctctgacctttcccgngtgtgccaaacngacttcccgttcaggtacaagggattccccacgggnagccctaaaccnaacagggcgtcaattttcaaggncggngtgaaaaagggccttttcagggt

SEQ ID NO: 34 - DNA, 730 bp, Homo sapiens
  misc_feature (701)..(701): n is a, c, g, or t/u
gtaattccaagcactggaattaagttgccttcatcagtgtttgcttcagagtttgaggaagatgttggattgttaaataaagcagctccagtttcaggacctcgactggattttgatcctgacattgttgcagctcttgatgatgattttgactttgatgatccagataatctgcttgaggatgactttattcttcaggccaataaggcaacaggagaggaagagggaatggatatacagaaatctgagaatgaagatgacagcgagtgggaagatgtggatgatgagaagggagatagcaatgatgactatgactctgcaggcctattgtcagatgaagactgtatgtctgtgcccggaaaaactcacagagctatagcagatcacttgttctggagtgaggaaacaaagagtcgcttcacggagtattcgatgacttcctcagtcatgaggagaaatgaacagctgaccctacatgatgagaggtttgagaagttttatgagcaatatgatgatgatgaaattggagctctggataatgcagaattggaaggttctattcaagtgggacagcaatcgcttacaggaagttttgaatgactactataaagagaaggcagagaattgtgtaaaattgaatacccttgaacccttggaggatcaagacctgcccaatgaatgagcttgatgagtctgaggangaagaaatgattactgtagtccttgaaaa

SEQ ID NO: 35 - DNA, 726 bp, Homo sapiens
  misc_feature (277)..(277): n is a, c, g, or t/u
  misc_feature (577)..(577): n is a, c, g, or t/u
  misc_feature (650)..(650): n is a, c, g, or t/u
  misc_feature (695)..(695): n is a, c, g, or t/u
  misc_feature (697)..(697): n is a, c, g, or t/u
  misc_feature (706)..(706): n is a, c, g, or t/u
atgaagatattttcctttaatttatcaaacatttcacattcatgaagtcatttacttcagagcaaatgtaagcttataatattaaaaattaaagtattacaatatttacaagatggttggcaggggacacttactagtataaaaataatacaaatattgtattttcctcttatctgccagtaaaaatggcaaacagttttgtctttctgaagtttctagtcaataaccaaagatgaggagcccctaataaagtgccttgccctgtatgctccactgnctatagctttagaccctcaacattcttcttcaagttcagcagctctttttcttgccttcttttctccagtttaaatgctaatttgttagctttcttctccactcttcgttccttgcgctcttcttttatagcttgctttcttgctcttttatcttctttgctttcatttttagaacgtggctgagttgatactttaggaagatcactgccattaatcatctgtattctttcagtttgctttgctgtgagtcctttctttggtaagacattgagaggtattcctgttttagaagatattcnaaatttgttttgggctttggttggatacttgataaagctgtggatggttatataaaatttgggtatgtaccancaaaataggattcacaaatccccacttctctttgggctttcttcnanggactaccngtaaatcatttcttcctccc

SEQ ID NO: 36 - DNA, 832 bp, Homo sapiens
  misc_feature (824)..(824): n is a, c, g, or t/u
agagcctgctggcagccggcagccacatgctgagggaggtgctggatgggcccgtggtgggacccgctcaagaacctgcggctcccacgggagctgaagcccacaataagtacagctggatgcgcaagaaggaggagcggatgtaccccatgaagtcctccgtggaggacatggacgtcctggaactggacttcagaatgtggcgggccgaggtccagcaccagtacaaggagaagcagcatgagctggtgaagctgcagcggcgccgggactccgaggacaggcacgaggagtcccatggaagcttggcacgcaggccgtggaaacagacccacgcccccgagcgccctgtcgcccgcccgcaagagggggaagaactgcaacagtagcggaaagctgagcagcaaatctctgccgacatcagatgactatgagctgggagcaggaataaggaagagacacaaagggcccaaggaggaacacaatgcccttattggaacagggaaagccagggagaggaaccagacttgggatgaacacgaggcttcgtctaagttcataagtcagctgaagattaagaagaagaagatggacagcgaccagtagcagttggcaaagcaagctcgacaaaggcccttttccttaccaagcaggacaagtttaaaatcacccttcaagttttcagacagtgcttgggggggaaatcaaaaacttggcagggggcttcaacaagtactttaacttcttatgacagccttgttgggcaaaggacaggaaggtgcttggccaagggcctttcgggcttgtttctgaaatctttccanagaaggta

SEQ ID NO: 37 - DNA, 1294 bp, Homo sapiens
  misc_feature (60)..(60): n is a, c, g, or t/u
  misc_feature (250)..(250): n is a, c, g, or t/u
  misc_feature (293)..(293): n is a, c, g, or t/u
  misc_feature (1171)..(1171): n is a, c, g, or t/u
  misc_feature (1178)..(1178): n is a, c, g, or t/u
  misc_feature (1180)..(1180): n is a, c, g, or t/u
  misc_feature (1195)..(1195): n is a, c, g, or t/u
  misc_feature (1231)..(1231): n is a, c, g, or t/u
  misc_feature (1251)..(1251): n is a, c, g, or t/u
  misc_feature (1279)..(1279): n is a, c, g, or t/u
gctatatatatatagatttattttactttaccgaaagacatatgctagaatattaatagngacactattaaccaaaagtcagtaaccactcaaatgctcatgcacagaatggataaagaaatggcaatatcatcacataatcaactattttgcagcaataaaaagaacaatatatttaaatcttacaatcataatactaagcaaaaaaaaaaaaaacaaaaaaaaacagaagcaaaagagcatattccgngagattccatttgtatcaagttcaaaagaaatcaaagatcatntacgcttttagaagtctggagatttattaaccatggttggatggacagtgatatgaaaggggcacaaggggcacttccaggttgctagcacgttctatcttttgatctgagtaaacagttacatgagtgtattaaaacagaggctttaaaaagagtgcctttgtgagcctttgacctctttatcaatacctactccccaggaatttgcaaccatttttatcacctccactttttgttttattgttgttgttaaaaatgaactcagtatgtttaataaagtttggtattatcaaaatcgcagtacaaacatcaagtcacacgcccacatgacagaattccatttataaaatgtttctcgggaagcccccactgggcccgtgcccaaagagagcctgaccacagcctggggtctctgggtgggcagaaaaggtgagtatgggggtggggaggaactcggggtagggggaggagggcggagaggaaggaaagtggagaaaaatgcagactcagaagcagtccatataacagctcaaaaagagctagccggcgatattatcacaacgatacagtacaaatcaaagcaaaaataaaaataatttggccgatacagcaggctacactgccaagaacccagatggcggccttcctgcggccatccgcacgggcctcctcacccaccatctctcccgtgcgcccactcgcttccttctcgctcactcgcaggcactctctcgctaggaaacacagaaagtattttgtgtttggagatagtaaccttagtcaaatgaatcttccgaagagtcgctgaaggaggaatgcaccttagcctctcgaagcagcaaacaaaaccactggttcctgctggtggcttggcttangtttcanantcccggaaggggccngaagaagggggtgtgtgccaggccccttttggtcancttaggggcccgcagcttgncttggttggcctttggcccccattgccncacaggaagggaaag

SEQ ID NO: 38 - DNA, 858 bp, Homo sapiens
  misc_feature (798)..(798): n is a, c, g, or t/u
  misc_feature (804)..(804): n is a, c, g, or t/u
ggcacgagccttggagaagctggaagcagccgagagccttgtcttggagcagagcttcctgcatggcatcaccctgctaagtgagatcgcagagctggagctggagaggaggagccaagagatgggaggtgcggagcgggccctggtggcgcggccctccctggagagtctgctggcagctggcagccacatgctgagggaggtgctggatgggcccgtggtggacccactcaagaacctgcggctcccgcgggagctgaagcccaacaagaagtacagctggatgcgcaagaaggaggagcggatgtatgccatgaagtcctccctggaggacatggacgccctggagctggacttccggatgcggctggccgaggtgcagcgccagtacaaggagaagcagcgtgagctggtgaagctgcagcgccgccgggactccgaggacaggcgcgaggaaccccatagaagcttggcacgcagaggccctggcaggccgcggaaacggacccacgccccgagcgccctgtcgcccccccgcaagagagggaagagcggccacagtagcggaaagctgagcagcaaagtctcttgctgacatcagatgattatgagctgggagcagggataagaaagagacacaaggggtctgaggaggaacatgatgcccttatcggaatggggaaagccagggggaggaaccagacttgggatgaacatgaggcctcgtcggacttcatcagtcagcttaagattaagaagaagaagatgcccacgaccaggagcattggcaagcaactngacaanggccttttccttaccaagcaggacaagttgaattgcccttcaagttttcggaca

SEQ ID NO: 39 - DNA, 634 bp, Homo sapiens
  misc_feature (110)..(110): n is a, c, g, or t/u
  misc_feature (120)..(120): n is a, c, g, or t/u
  misc_feature (177)..(177): n is a, c, g, or t/u
  misc_feature (246)..(246): n is a, c, g, or t/u
  misc_feature (260)..(260): n is a, c, g, or t/u
  misc_feature (327)..(327): n is a, c, g, or t/u
  misc_feature (404)..(404): n is a, c, g, or t/u
  misc_feature (432)..(432): n is a, c, g, or t/u
  misc_feature (548)..(548): n is a, c, g, or t/u
  misc_feature (559)..(559): n is a, c, g, or t/u
  misc_feature (561)..(562): n is a, c, g, or t/u
  misc_feature (568)..(568): n is a, c, g, or t/u
  misc_feature (575)..(575): n is a, c, g, or t/u
  misc_feature (589)..(589): n is a, c, g, or t/u
  misc_feature (595)..(595): n is a, c, g, or t/u
  misc_feature (599)..(599): n is a, c, g, or t/u
  misc_feature (607)..(607): n is a, c, g, or t/u
  misc_feature (622)..(622): n is a, c, g, or t/u
agttaaaaatgaactcgatatgtttaataaagcttggtattaccaaaatcgcggtacaaacatcaagtcacacgcccacacgacagaattccatttacaaaatgttcctngggaagcctncaccgaacccgtgcccaaagagagcccgaaccaagcctggggtctctgggtgggcanaaaacgtgagtgcgggggtggggggaactcgggggagggggaggagggcagggaggagggcaagtgganagaaacgcagactnaaaagcagccatataacagctcaaaaagagccagccggggatattatcacaatgatacagtcaaatnaaagcaaaaatcaaaatcattcggctgataacagcaagctacgctgccaagaacccatatggcagccttcttgcggncattcgcacgggccttttacccaccatntttcccgtgcgcccactcgcttcccttttgcttacttgcacgccttttttgctaggaaacacggaaggttttttgggtttggagctagtaaccttggcaaaccgtttcctccgaanagttgctgaangnngaaacncgccttnggctttcgaaacanctgacnaaangggtgttncttgcttggggccgntttgggtttaaa

SEQ ID NO: 40 - DNA, 1244 bp, Homo sapiens
ggagccttccctcagttgtaacagtctgaatttggggtgatggagaccaggaatttgcctatttaacaggctctccaggtgatttgaatgtacatggaagttgtaaaaccactggtatagatcatatggagagagggttacctgtttaaaatacagattcccaggcctgtctctttaaggctcaggtggaggaggtccaggaaaggggatagggaatctgtggtaaaataatcaagcaagtttggggaacggtaggctatagaaactctgtaaagcccttagatttttacatctagaattctatacccaacactttgggtaaagcctccgggaggcactttaaaagtggactttactcacgtgctcctgcagggaacaagatacagataatcccgaatcgagcaagagttcttttctggaaagcctcgggtaagttgatttttaagtaggatggaatcccgttgattcactctgaatttcaggacatttaagtagcatctgcaaggtgatgatatcagtgtgtgaaggaaagggtgtggcttccagataatggtccttcctgttgaatacagcattttcctttaatgcagaaaaaaaactatgtatgacttgatggagagctttacataaagtccaaggagccatttgaaagctttgcatcaattcgagaagcagacttggactgggctaactaaggcagtttactaatagtgtgaagagagggagtgtaatattgatatggcaaaagagaattgttgctttggtgttaaccaggtgtcccttctctgcagtgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctattttctgcttgcgtttttgaaacaggaggtgcacgtaccacccaattatctatggcagcatgcatgtataggccgaactattttcagctctgatgtttcagagagaagacctcagaaaccgaaagaaaaccaccaccctcctattgtgtctgaagtttcacgtgtgtttatgaaatctaatgggaaatggatcacacgatttctttaagggaatt

SEQ ID NO: 41 - DNA, 780 bp, Homo sapiens
  misc_feature (585)..(585): n is a, c, g, or t/u
  misc_feature (632)..(632): n is a, c, g, or t/u
  misc_feature (636)..(636): n is a, c, g, or t/u
  misc_feature (661)..(661): n is a, c, g, or t/u
  misc_feature (705)..(705): n is a, c, g, or t/u
  misc_feature (733)..(734): n is a, c, g, or t/u
  misc_feature (742)..(742): n is a, c, g, or t/u
ggcacgagcagaagtacaggagaagaaaaaaaagatgaagaatgagaacgcagacaagttacttaagagtgaaaagcaaatgaagaagtctgagaaaaagagcaagcaagagaaagagaagagcaagaagaaaaaaggaggtaaaacagaacaggatggctatcagaaacccaccaacaaacacttcacgcagagtcccaagaagtcagtggccgacctgctggggtcctttgaaggcaaacgaagactccttctgatcactgctcccaaggctgagaacaatatgtatgtgcaacaacgtgatgaatatctggaaagtttctgcaagatggctaccaggaaaatctctgtgatcaccatcttcggccctgtcaacaacagcaccatgaaaatcgaccactttcagctagataatgagaagcccatgcgagtggtggatgatgaagacttggtagaccagcgtctcatcagcgagctgaggaaagagtacggaatgacctacaatgacttcttcatggtgctaacagatgtggatctgagagtcaagcaatactatgaggtccaataacaatgaagtctgtgttngatctgatcgatactttccagtcccgaattaaagatatggagaagcngaanaaaggagggccttgtttgcaaaganggccaaaaagccagtcccttggagaactttcctatccaaggttnccgttggaaggaaggaaggttgcttggnngaactctngttccttaccgatgaaaaactggggcctatttcacagc

SEQ ID NO: 42 - DNA, 790 bp, Homo sapiens
  misc_feature (502)..(502): n is a, c, g, or t/u
  misc_feature (505)..(505): n is a, c, g, or t/u
  misc_feature (574)..(574): n is a, c, g, or t/u
  misc_feature (582)..(582): n is a, c, g, or t/u
  misc_feature (711)..(711): n is a, c, g, or t/u
  misc_feature (734)..(734): n is a, c, g, or t/u
attgcgatatccactttattatggtggtctggaactgatcctgtaatatctccatggtatgcctgtgctgtacagggggtaaagtgtgaggggtcaagaattttcatgccagaaattccatagcagcctactagaactctggaagtatcgcctttggctgcagtgccagattctggtgaggatttcctggaccccgatttatatctgaaaaaacactaaaaataacagaagcagggcaggaagtggctatgataacaaagctgggcttggtactttctctggcttttgtggccaatattactggactcccgtggtatcaagtttcataaaagaaactcatacaaagcagagatatcttaattattttcagactggcatttcaaaaagtgtcaatttaagtaagtattataagttatttgttctttgttttatcttttcagatgtttcttgaaaacattgtggtgtgatctttaacagagttttcacttaccaattaatacanaanataagaaaaagctttaaatacatattttataaaattttatatgccaaataaggggccttcatataaganaaggaaantaatatcaaattttcagtactattatttagcactagaagcccctccagtttagaaaaacaattcttttaaatgtctttatgatttgaggttcaataataacctcatggaatagggtgaaagtttgctanttattttagtcctttagaaaaancacttgaaagaaaaaaggcagggaaatggtagtccgcagtgtgggaaaaaatggaa

SEQ ID NO: 43 - DNA, 761 bp, Homo sapiens
  misc_feature (308)..(308): n is a, c, g, or t/u
  misc_feature (542)..(542): n is a, c, g, or t/u
  misc_feature (544)..(544): n is a, c, g, or t/u
  misc_feature (571)..(571): n is a, c, g, or t/u
  misc_feature (594)..(594): n is a, c, g, or t/u
  misc_feature (597)..(597): n is a, c, g, or t/u
  misc_feature (636)..(636): n is a, c, g, or t/u
  misc_feature (651)..(651): n is a, c, g, or t/u
  misc_feature (668)..(668): n is a, c, g, or t/u
  misc_feature (681)..(681): n is a, c, g, or t/u
  misc_feature (685)..(685): n is a, c, g, or t/u
  misc_feature (698)..(698): n is a, c, g, or t/u
  misc_feature (704)..(704): n is a, c, g, or t/u
  misc_feature (710)..(710): n is a, c, g, or t/u
  misc_feature (720)..(720): n is a, c, g, or t/u
  misc_feature (729)..(729): n is a, c, g, or t/u
  misc_feature (753)..(753): n is a, c, g, or t/u
  misc_feature (756)..(756): n is a, c, g, or t/u
ggcacgaggcggcggcggcgcgcgcctgagaagaggggacgccagcccggtcaggcctcggcgcggcctacacgctccgctcgctcgctcgctcccgcctcccgccccgcgcccggccatggcggagccgtcgtccgcccgacgcccggtgcctctcatcgagtcggagctgtacttccttatcgcccggtacctatcggcgggcccgtgtcggagagcggcccaggtgctggtgcaggagctggagcagtaccagttgttgccgaagagattggactgggagggcaacgagcacaacaggagctacnaggagttggtcttgtccaataagcatgtggctcctgatcatcttttgcaaatctgcgagcgcatcgggtcctatgttggataaagaaattccacccagtatttcaagagttcacttctttacttggtgcaggaaggcagtctttgctacgtacaagtaaaagactgcaggcacacagtttggaagggctctgcctttgctgctcttcatagaggaagaccttctgaaatgccantnaattatggtttcccaccaaattcttgngggagatacatcgagggaaaacnacntcacagggtgtttcacttttagtccagcattttccaggnaacttatgtattaancaatattaaaaaatgcncaaaaagggattnttcnggacattcttatnttgctnggttanctggggtacncttttgatnggacagggacatttgaaacttttncanggttc

SEQ ID NO: 44 - DNA, 789 bp, Homo sapiens
  misc_feature (14)..(14): n is a, c, g, or t/u
  misc_feature (51)..(51): n is a, c, g, or t/u
  misc_feature (90)..(90): n is a, c, g, or t/u
  misc_feature (100)..(100): n is a, c, g, or t/u
  misc_feature (102)..(103): n is a, c, g, or t/u
  misc_feature (109)..(109): n is a, c, g, or t/u
  misc_feature (129)..(129): n is a, c, g, or t/u
  misc_feature (217)..(217): n is a, c, g, or t/u
  misc_feature (242)..(242): n is a, c, g, or t/u
  misc_feature (284)..(284): n is a, c, g, or t/u
  misc_feature (340)..(342): n is a, c, g, or t/u
  misc_feature (346)..(346): n is a, c, g, or t/u
  misc_feature (385)..(385): n is a, c, g, or t/u
  misc_feature (425)..(425): n is a, c, g, or t/u
  misc_feature (427)..(427): n is a, c, g, or t/u
  misc_feature (515)..(515): n is a, c, g, or t/u
  misc_feature (522)..(522): n is a, c, g, or t/u
  misc_feature (544)..(544): n is a, c, g, or t/u
  misc_feature (547)..(547): n is a, c, g, or t/u
  misc_feature (565)..(565): n is a, c, g, or t/u
  misc_feature (569)..(569): n is a, c, g, or t/u
  misc_feature (582)..(582): n is a, c, g, or t/u
  misc_feature (588)..(589): n is a, c, g, or t/u
  misc_feature (593)..(593): n is a, c, g, or t/u
  misc_feature (596)..(596): n is a, c, g, or t/u
  misc_feature (624)..(624): n is a, c, g, or t/u
  misc_feature (627)..(627): n is a, c, g, or t/u
  misc_feature (633)..(633): n is a, c, g, or t/u
  misc_feature (644)..(644): n is a, c, g, or t/u
  misc_feature (649)..(649): n is a, c, g, or t/u
  misc_feature (657)..(657): n is a, c, g, or t/u
  misc_feature (661)..(661): n is a, c, g, or t/u
  misc_feature (663)..(663): n is a, c, g, or t/u
  misc_feature (680)..(680): n is a, c, g, or t/u
  misc_feature (692)..(692): n is a, c, g, or t/u
  misc_feature (715)..(715): n is a, c, g, or t/u
  misc_feature (726)..(726): n is a, c, g, or t/u
  misc_feature (728)..(728): n is a, c, g, or t/u
  misc_feature (733)..(733): n is a, c, g, or t/u
  misc_feature (752)..(752): n is a, c, g, or t/u
  misc_feature (768)..(768): n is a, c, g, or t/u
  misc_feature (781)..(781): n is a, c, g, or t/u
  misc_feature (785)..(785): n is a, c, g, or t/u
gaaaacttgcattncttcctctgaaaatctgtcttggatacataaacattntgaagagtgataatatatatattgccaagctgcctttcngaaactctangnngtagcntttaacattttacacaccantcagcaacatacaaattttgcccattgacaaacaagccattcccacaggatcttaaggtttggttacagcagaaatgttatcaagtangaaagaaagtgataaaatatgtttncaacaggtttttaaatagatttgtaagtaatttaactatgtntgtgctaaaatgtttaatgatttaataatgccatcatcctaccctaagatccattnnntctncatggctccttattagggttgagttcataaatattattncttcttacagcctcaatataagcttcatgaccctgtcganantatattacctcatcacccatttgaggaacaaaaggagattttctaagtgtggtgtcagtaatccaaactggagggtgaaattcatatnaatgctnctatttgcaagctctgctggangcntcctccgcaaattctccntctnaggcttattgtcnttcttnntctntcngcttctttttggaggagataaattctcngtnagatanttccatccttntgaantactacangaancntagtaaattcggtcgancgacactgatgnccttaatgggaggcctgccaaanttgatgccccntnttcancttgtccaattcgggaatntctagaggaagagtcncttggaacttttnctgnaacc

SEQ ID NO: 45 - DNA, 738 bp, Homo sapiens
  misc_feature (452)..(452): n is a, c, g, or t/u
  misc_feature (476)..(476): n is a, c, g, or t/u
  misc_feature (487)..(487): n is a, c, g, or t/u
  misc_feature (552)..(552): n is a, c, g, or t/u
  misc_feature (560)..(560): n is a, c, g, or t/u
  misc_feature (573)..(573): n is a, c, g, or t/u
  misc_feature (585)..(585): n is a, c, g, or t/u
  misc_feature (589)..(589): n is a, c, g, or t/u
  misc_feature (597)..(597): n is a, c, g, or t/u
  misc_feature (614)..(614): n is a, c, g, or t/u
  misc_feature (622)..(622): n is a, c, g, or t/u
  misc_feature (660)..(660): n is a, c, g, or t/u
  misc_feature (682)..(682): n is a, c, g, or t/u
  misc_feature (728)..(728): n is a, c, g, or t/u
gccctcggcacctcccgacgcgctccctggaggccttcgccgaggaggtcggcgccgcgctgcaggcttccgtggagccaggggcggctgacggcgagggcggcccgggcccggcggcgctgccctgcacgctggccatgtgggagttgggccactgcgacccccggcgctgcacgggccgcaagctggcccgcctggggctggtgcgctgcctgcgcctgggccacagattcggcggtctggtgctgagccccgtgggcaagcagtacgcgtcccccgcagacagacagctggtggcgcagtctggggtcgccgtcatcgactgctcctgggccaggctggacgagacaccgtttgggaagatgcgagggagccacttgcgcctgttgccctacctggtggccgcaaccccgtgaactatggccggccctacagactttcctgcgtggaancgtttgctgccacctttctgcatngtaggcttttncagaccttgctgtcattttgctgcggaaagtttaaatggggcaaggggcttcttggacctgaacncgccaagntcctggacaagtncccggtcttgcngcanccccggangaagtgctttaaggcgnaacaaganttcttgggcaaattgccaatggaaaagcccccaagganggaggaaaatcgaatccctttnaatgtgggattcaaggggaaaaaaattttggaaaaccccaaaaggnccttttggcc

SEQ ID NO: 46 - DNA, 760 bp, Homo sapiens
  misc_feature (653)..(653): n is a, c, g, or t/u
  misc_feature (732)..(732): n is a, c, g, or t/u
ggcacgagcatttattcaggaagattactaagcagagctaacactgaaaaatcttatggtattgatgaaaacgggagagatgagaatactatgaaaaatatattttcaaaaaagaggaaattagaagttgcatgttcagattgtgaagttgaagttctcccattaggattggaaacacatcctagaactgctaaaactgagaaatgtccaccaaagttcagtaataatcccaaggagcttactatggaaacgaaatatgataatatttcaagaattcagtatcattcagttattagagatcctgaatccaagacagccatttttcaacacaatgggaaaaaaatggaatttgtttcctcggagtctgtcactccagaagataatgatggatttaaaccaccccgagagcatctgaactctaaaaccaagggagcacaaaaggactcaagttcaaaccatgttgatgagtttgaagataatctgctgattgaatcagatgtgatagatataactaaatatagagaagaaactccaccaaggagcagatgtaaccaggcgaccacattggataatcagaatattaaaaaggcaattgaggttcaaattcagaaacccccaagagggacgatctacagcatgtcaaagaccagcangtattttgtgatgaagaagttgcttaagtgaaacccaggaatacttcatctgattctcttaccaaaggttcaattaaanggggaatgtggtttttattgggatgccc

SEQ ID NO: 47 - DNA, 792 bp, Homo sapiens
  misc_feature (676)..(676): n is a, c, g, or t/u
  misc_feature (721)..(721): n is a, c, g, or t/u
  misc_feature (744)..(744): n is a, c, g, or t/u
  misc_feature (761)..(761): n is a, c, g, or t/u
ataatattttttttctacatttattaaccccacattggcagaagatttccttctcaggcacagtcccagcttcatagccataatcccatgttagctctgttcttgctttcacatacctgttggtgaagaatgccaccaatggaaaattcctgttgtgtgtttctacaaaaacattctgtaccaagagatttgggcaacaactatgattaaggaagcggccgacatttccttcttttgtggcatccaataaaaacacattccctttattgaactttgttagagaatcagatgaagtattcttggtttcacttagcaactcttcatcacaaaatacctgctgtctttgacatgctgtagatcgtccctcttggggtttctgaatttgaacctcaattgcctttttaatattctgattatccaatgtggtcgcctggttacatctgctccttggtggagtttcttctctatatttagttatatctatcacatctgattcaatcagcagattatcttcaaactcatcaacatggtttgaacttgagtccttttgtgctcccttggttttagagttcagatgctctcggggtggtttaaatccatcattatcttctggagtgacagactccgaggaaacaaattccatttttttcccattgggtttgaaaaatggctggcntgggattcaaggatctctaataacctgaatgaatacctgaattcntggaaatattatcataatttcgngtttccatagtaagccncccttgggaattaattaactgaacctttggg

SEQ ID NO: 48 - DNA, 823 bp, Homo sapiens
  misc_feature (657)..(657): n is a, c, g, or t/u
  misc_feature (789)..(789): n is a, c, g, or t/u
  misc_feature (802)..(802): n is a, c, g, or t/u
cctaaacaccctttcaaccccagaggagaagctggcagctctctgtaagaaatatgctgatcttctggaggagagcaggagtgttcagaagcaaatgaagatcctgcagaagaagcaagcccagattgtgaaagagaaagttcacttgcagagtgaacatagcaaggctatcttggcaagaagcaagctagaatctctttgcagagaacttcagcgtcacaataagacgttaaaggaggaaaatatgcagcaggcacgagaggaagaagaacgacgtaaagaagcaactgcacatttccagattaccttaaatgaaattcaagcccagctggagcagcatgacatccacaacgccaaactccgacaggaaaacattgagctgggggagaagctaaagaagctcatcgaacagtacgcactgagggaagagcacattgataaggtgttcaaacataaggaactgcaacagcagctcgtggatgccaaactgcagcaaacgacacaactgataaaagaagctgatgaaaaacatcagagagagagagagtttttattaaaagaagcgacagaatcgaggcacaaatacgaacaaatgaaacagcaagaagtacactaaaacagcagctttctctttatatggataagtttgaagaattncagactaccatggcaaaaagcaatgaactgtttcaaccttcagacaggaaatgggaaaagatgccaagaaaattaaaaactgggaaaagaaaccattaattggggttcccaatggggaaacaatattaaacncttttgcaatggntgaagaaaaaacagtccgggt

SEQ ID NO: 49 - DNA, 700 bp, Homo sapiens
  misc_feature (636)..(636): n is a, c, g, or t/u
  misc_feature (649)..(649): n is a, c, g, or t/u
  misc_feature (653)..(653): n is a, c, g, or t/u
  misc_feature (688)..(688): n is a, c, g, or t/u
gttaagtttatcatacatatttacttaatctatacagaatcaagtagataaaatcagattcacattagtgaaaaatctctacaaaatgtctttgaaaagcaaaacgagactgcctcttaacaattcgtatcctcatgaaagacgtgggctgtaaaaataaagcagtgtgtttagcacaaactagaagatatctgcatcatttttttcacagttatttccatctacagtctgaaagaggtagatttttctgcaacacctgagaattgaattgtgataaccaggtgtaataaaggcagttgcatacataactgaaaaatactggtctcaagaccaagaaatgtactcctaacaagtctgaggatgaaatggtccatattacccaagacccaagttttctctacaccttggagtccaccgccaatataaataatacacatcacgattccatgatggtgcaacaattgcaatttaagtgaattcaacatttaaaccttttctgggccagcctagtagcattacagtgttctagaatatggtagatatggggtgcgctacaaagccacaacactgggctggtgaggtgatcctgtaggaagatgtccttctcaaggggtcccatttggtttttattcacangggtaatggggangaanggttctgaaaggacaaccaaatgccttcccggacnggaaatccatat

SEQ ID NO: 50 - DNA, 911 bp, Homo sapiens
  misc_feature (679)..(679): n is a, c, g, or t/u
  misc_feature (772)..(772): n is a, c, g, or t/u
  misc_feature (799)..(799): n is a, c, g, or t/u
aggagctgggcccagagacgcggggacgggccgtgggcccccggaacgaggcaaagatgctggaaggagatctggtttcaaagatgctgcgagctgttctgcagtctcataagaatggagtagcattaccccggctccaaggagagtacagatccttgactggagactggatccccttcaaacagctaggtttccctacactagaagcctatctgagaagtgtgccagcagtggtcaggatagagactagtagatctggagagattacctgctatgccatggcctgcacagaaactgcaagaattgctcagcttgtggctcgtcaaaggagttctaaaaggaaaaccgggcgtcaagttaattgtcagatgagagtgaagaaaaccatgccattttttctagaaggaaaaccaaaagcaaccctcagacaaccaggatttgcttcaaatttttctgttggcaaaaaacctaatccagcaccgttaagagacaaaggaaactctgctggagttaagcctgatgctgaaatgtctccttatatgctacacacaactctttggaaatgaagcattcaaagacattccagtgcaaaggcatgtgaccatgtccaccaacaacaggtttagcccaaaggcgtcccttcaaccaccttttgcagatgcatcttttcaagaacctnttacttaagggaaatgaatggataattttaaatcagactgttgaaaaaaccccatggtcaagcccttctggctttttaccccttattaaaaanggattgaaggttcaaaaattcgcattnaagggaaattcttaaccaaggccttaccaatggcattttggggatatctaagctttccccttttttaccaaggaggtttttttaaggaagacccttattccagggaattttt

SEQ ID NO: 51 - DNA, 781 bp, Homo sapiens
  misc_feature (691)..(691): n is a, c, g, or t/u
  misc_feature (720)..(720): n is a, c, g, or t/u
  misc_feature (723)..(723): n is a, c, g, or t/u
  misc_feature (733)..(733): n is a, c, g, or t/u
  misc_feature (738)..(738): n is a, c, g, or t/u
  misc_feature (745)..(745): n is a, c, g, or t/u
  misc_feature (766)..(766): n is a, c, g, or t/u
attgataaacatttttattctaatattatagtaataattcaagtacaattttctttgaaaagtcaactctgttaaaacaaaacttgttaaatatctttcatcaaacataagcatattcttttcaatcccccacagcagtcagagccatgtagcagagttaagattttttttaagcctactacattttgttattgctaaaaaatctgaattagttgtcaaggtttcagaggcagtcattaattaacttttgaaagctctatcagatactctgacataaaatcatgaatccaggtatcggtgtctggcaacgatgtgtccactaagtagaccactactttccggtcccaagggttagcattttcaatgactgtctgcaccagtgccaccagaggtttcttctccacatgatttcgaaacaccatagaagcctcctcagaccactggttgcacttcactcctgcaagttgagctgtgactgcttggaagggcagctttcggaacatgtccactaggggctgtacttttcttatgttgactaattcgtgtttgccataatccagctcatacacagataccagtccattggtcaggattccttttaaaaagcaccctgtgccacttattttccacttttgcagcatacacttggtctttctccactgctatgtgggcgctcttcagacaccgctgnaatatagaatcatctcttccatcagaacnttncaacttatgnatctnctgccangctggatgaccaaagtagccngggtgacaggcccca

SEQ ID NO: 52 - DNA, 734 bp, Homo sapiens
cagaagctcgcagtgctgcacaggtagctctgtgcattcagcaattacagaaatcaatagcatgggaaaaatcaattatgaaagtttactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacactgtgaaacatttaatggaagatgattctgatataggcaga

SEQ ID NO: 53 - DNA, 729 bp, Homo sapiens
  misc_feature (557)..(557): n is a, c, g, or t/u
  misc_feature (581)..(581): n is a, c, g, or t/u
  misc_feature (708)..(708): n is a, c, g, or t/u
acaaacgtcttttaaatttatttctgaggcaaggcaaatgggagggaaatgtttctatgaaaaaatactgtgtgcgtaggaaattgtcacaattttattccacatggatacaaatgattatactttaatttaggccctggtggcttaaaattatataacaaaatagaaaaatggaaaactaatatcccctacaccctgtttcaaaggcaggcactaccaagattaaggagacgccacagtgttggtagaggataattactgtacagactgtatagctatcattaccttcagacgaaaataaaatgctacaatcctctaaggcatgaacaataatgtctgcaaacaatatatacacataatacatatttaaaacaagacttaatataaacaagaatgaacagtatatacatgtcaattttttcactgttttgaaatacaatttaactacacaagtgatgcagcaacatatatatataaatgtacttgtaactctacagtaaagtttctttttggtgcttttatagcacatcagtgtaaacagtttaacttggctttgntttatattttaaaacattccttgnattttcaagatttaaagccattttctaggtcttccttttcacaggaaaacgaagattctggatgtgggttaatcattaaataattcattaaaattaaatccattcacttaaaaatttaacttccaangttaaaaaatgaaaaatagat

SEQ ID NO: 54 - DNA, 779 bp, Homo sapiens
  misc_feature (571)..(571): n is a, c, g, or t/u
  misc_feature (597)..(597): n is a, c, g, or t/u
  misc_feature (605)..(605): n is a, c, g, or t/u
  misc_feature (641)..(641): n is a, c, g, or t/u
  misc_feature (665)..(665): n is a, c, g, or t/u
  misc_feature (682)..(682): n is a, c, g, or t/u
ggcacgagggaagccgtccctagtgagggagacgtcccgcatcacggtgcttgaggcgctgcggcaccccatccaggtcagccggcggctcctcagtcgaccccaggacgcgctggagggtgttgtgctcagtcccagcctggaagcacgggtgcgcgacatcgccatagcaacaaggaacaccaagaagaaccgcagcctgtacaggaacatcctgatgtacgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctctttgtggatgaagcggacgccttccttcggaagcgagccaccgagaagataagcgaggacctcagggccacactgaacgccttcctgtaccgcacgggccagcacagcaacaagttcatgctggtcctggccagcaaccaaccagagcagttcgactgggccatcaatgaccgcatnaatgagatggtccacttcgaccttgncagggcangaaggaacgggagcgcctggtgaagaatgtattttnacaagtatgtttcttaagcccggncccagaaggaaacacgncctgaaacttggccccagtttgacttaccgggagggaaattcttcggaaggtcgcttcggcttgaccgaagggccttttcggggcccgggagaatcg

SEQ ID NO: 55 - DNA, 716 bp, Homo sapiens
  misc_feature (84)..(84): n is a, c, g, or t/u
  misc_feature (115)..(115): n is a, c, g, or t/u
  misc_feature (117)..(117): n is a, c, g, or t/u
  misc_feature (140)..(140): n is a, c, g, or t/u
  misc_feature (285)..(285): n is a, c, g, or t/u
  misc_feature (287)..(287): n is a, c, g, or t/u
  misc_feature (302)..(302): n is a, c, g, or t/u
  misc_feature (307)..(307): n is a, c, g, or t/u
  misc_feature (358)..(358): n is a, c, g, or t/u
  misc_feature (379)..(379): n is a, c, g, or t/u
  misc_feature (424)..(424): n is a, c, g, or t/u
  misc_feature (529)..(529): n is a, c, g, or t/u
  misc_feature (568)..(568): n is a, c, g, or t/u
  misc_feature (578)..(578): n is a, c, g, or t/u
  misc_feature (610)..(610): n is a, c, g, or t/u
  misc_feature (619)..(619): n is a, c, g, or t/u
  misc_feature (623)..(623): n is a, c, g, or t/u
  misc_feature (637)..(637): n is a, c, g, or t/u
  misc_feature (661)..(661): n is a, c, g, or t/u
  misc_feature (663)..(663): n is a, c, g, or t/u
  misc_feature (680)..(680): n is a, c, g, or t/u
  misc_feature (690)..(690): n is a, c, g, or t/u
gaggcacctgtgggactttattaggtaaacagaccccagctccagccacaggcttggaccggccagctgacagtgcggcctcanacacccccgccaggttccctcctccctcctntntcagggtcaccagtgtgtgaaanatcggggcatgccggccacagggggaagcagggttcaggctgccccacctgggtctggccctggcaggcgccccctcacctggctctgctgtgggagccgagaacaaagacatcacctgcctggctcctgctgccccgggggctnanccagcacccaccctnacagnggcctgggcaggggctggggtgcaaagcctcaccctccccctgtgagccanacggaaaatgcatttcccaanagtgtctcgaggggcaggaaggaggcctgcccctccctagccagngcctacaacagggggtgccctggggggcaaaacgaccgaccgccaccacaagacatcctgggggacaaaggccctgggcacagcccaatccccatccaggagcanatcctaaatgtgcaggggccggcaaggcaggggtggganggggtccgcngccaggcttccgtgagctgtggatctccctgnggacttcangatngggagggcttcgtncccacgcccaggccctttcgcttnanccagcacaatcttctgntggtgctgcnggacagtatttttcacccgggtgtcc

SEQ ID NO: 56 - DNA, 748 bp, Homo sapiens
  misc_feature (666)..(667): n is a, c, g, or t/u
  misc_feature (700)..(700): n is a, c, g, or t/u
  misc_feature (728)..(728): n is a, c, g, or t/u
ggcacgagcagaggttgagaagcagacatcattaacaccaagagagttagaaataagaagacgggaggatgagtacagatttacaaaattgcttcagattgctggaattagcccacatggtaatgctttaggagcatcaatgcagcaacaggtaaatcaacaaatacctcaggaaaaacgaggaggtgaagtattggattcttctcatgatgacataaaacttgaaaaaagtaatattttgctgcttggaccaactgggtcaggtaaaactctgctggcacaaaccctagctaaatgccttgatgtcccttttgctatctgtgactgtacaactttgactcaggctggatatgtaggcgaagatattgaatctgtgattgcaaaactactccaagatgccaattataatgtggaaaaagcacaacaaggaattgtctttctggatgaagtagataagattggcagtgtgccaggcattcatcaattacgggatgtaggtggagaaggcgttcagcaaggcttattaaaactactagaaggcacaatagtcaatgttccagaaaagaattcccgaaagctccgtggagaaacagttcaagttgatacaacaaacatcctgtttgtggcatctggtgctttcaatgggtttagacagaatcatcagcnnggagggaaaaatgaaaagtatcttggatttggnacacccatctaatctggggaaaaaggcnataaaggcttgcagctgctt

SEQ ID NO: 57 - DNA, 718 bp, Homo sapiens
  misc_feature (360)..(360): n is a, c, g, or t/u
  misc_feature (383)..(383): n is a, c, g, or t/u
  misc_feature (446)..(446): n is a, c, g, or t/u
  misc_feature (475)..(475): n is a, c, g, or t/u
  misc_feature (486)..(486): n is a, c, g, or t/u
  misc_feature (494)..(494): n is a, c, g, or t/u
  misc_feature (504)..(505): n is a, c, g, or t/u
  misc_feature (547)..(547): n is a, c, g, or t/u
  misc_feature (608)..(608): n is a, c, g, or t/u
  misc_feature (649)..(649): n is a, c, g, or t/u
caattttaaagaatttattttcccatttgtagagtaacattattgtaaaatctacagttatcgcaatacctgcattgcttaaaagaattcctaagaattttgttaaagcatattttttttaaaaaactgaaccaaaataatgtacattttatctctaaacattgtgtcattaaagtccatataacatcttccgtaaaatcaatgtgatgttacaattatatacatgatctgattcttctcctaaaggcttctctgaccatgtatgatatccaagatagatccaatgcctttaatatcagactgtagagacaattatgatcctaaacaaaagaaggaaaagctgtatatacaagacagcantatgacagtttagctgtttgcancatctgcttggcggggccatccttcttcttcaactccagagtcatactcctcttcagaggatncttttgttggagcccggatgtatcctggnctccttttttncttctacnacttctttgnnaacctccacacataccgatatcagaattagggacttcaaacnttggttcctagtaacagcttttccattatggaccgaaggcctcgtgcaccctgttttcggntctagtgccaatctgggctatagcttttcaaagcatcctcngtaacattcaggtcacacttatccatgctgaataaggcctggtctgggggaataacagcatttccgggg

SEQ ID NO: 58 - DNA, 857 bp, Homo sapiens
  misc_feature (550)..(550): n is a, c, g, or t/u
  misc_feature (788)..(788): n is a, c, g, or t/u
  misc_feature (797)..(797): n is a, c, g, or t/u
  misc_feature (821)..(821): n is a, c, g, or t/u
  misc_feature (838)..(838): n is a, c, g, or t/u
ctcgcgcgcctgcaggtcgacactagtggatccaaaggaaaacatggacacaagcaacaccagcatcagtaaaatgaaaagatccagacccacatctgagggctctgacattgagtccactgaaccccaaaagcagtgctcaaagaaaaagaaaaaacgggacagagttgaagcatctagcttacctgaagtcagaacagggaagaggaagagaagcagctctgaagatgcagaatccctagctccccgatcaaaagtaaagaaaattattcagaaagacatcattaaggaagcatcagaagcttccaaggaaaatagagatatagaaatctctactgaagaggaaaaggatactggagatctaaaagatagctctctcttgaaaacaaaaaggaaacataagaaaaaacataaagagagacataaaatgggagaagaagttataccattaagagtgctatcaaagagcgaatggatggatttgaaaaaagagtatttagcgctacaaaaagctagcatggcttctttaaaaaaaacaatatcccaaatnaaatcagagtcagaaatggaaacagacagtggagtacctcaaaacactggaatgaaaaatgaaaaaacagccaacagggaagagtgtcgcacccaggagaaagttaatgcaacaggaccacagttcgtgagtggagtgattgtgaagatcattagcacagagcctctcctggcaggaaacaagtccgggatctttgggagcaatctcagaaagtttttttatgttgatttgctagaangggaaccanaatggcctgctagattaaaaactnctgaggatgctcaagcngtaataaatgcctttcccg

SEQ ID NO: 59 - DNA, 700 bp, Homo sapiens
  misc_feature (348)..(348): n is a, c, g, or t/u
  misc_feature (467)..(467): n is a, c, g, or t/u
  misc_feature (611)..(611): n is a, c, g, or t/u
  misc_feature (615)..(615): n is a, c, g, or t/u
  misc_feature (624)..(624): n is a, c, g, or t/u
aatgttcaaaacacatttatttactaaatcacctgacactgacatctaagataatttcaacaaataaaatgtttaagaaaaattgtggtatacatcatatttgtctctagaaaaaagtcttatttacaagttgaggaacaaagatatttcttttaattaaaaacacattaattatgcagtgctaccataataaaagtgaatctcccaagaacagctcaagtatcttgtgaagtattaagaggtgaactgttttttttttcaatcatattcagaaaatcttatatgtttactcgcttgttgagtctttgccagtctaatcttttcagctttggtgattaacttttcagngcctcttttcttttcccgaggctgattaagttttgcctgtctatcaaccaaaatcttctgccaatacctttgttcgtgatcaccagaaaggatctcgagtttccagcagtgtttcttgntaatttctgtataggcatttattactgcttgagcatcctcaggagttttaaatctagcatggcattctgtatccccttctagcaaatcaacctaaagaacttctgagaatgctgccaaagtatcccggacttgtttcctgccangtanaggctctgngctaatgaacttcacaatcctccacttcacgaacttgggggccctgttgcattaacctttctccctgggggccgaa

SEQ ID NO: 60 - DNA, 1889 bp, Homo sapiens
ctggacatggctccagagatcaacttgccgggcccaatgagcctcattgataacactaaagggcagctggtggtgaatccagaagctctgaagatcctatctgcaattacgcagcctgtggtggtggtggcgattgtgggcctctatcgcacaggcaaatcctacctgatgaacaagctggctgggaagaaaaacggcttctctctaggctccacagtgaagtctcacaccaagggaatctggatgtggtgtgtgcctcatcccaagaagccagaacacaccctagttctgctcgacactgagggcctgggagatatagagaagggtgacaatgagaatgactcctggatctttgccttggccatcctcctgagcagcaccttcgtgtacaatagcatgggaaccatcaaccagcaggccatggaccaacttcactatgtgacagagctgacagatcgaatcaaggcaaactcctcacctggtaacaattctgtagacgactcagctgactttgtgagcttttttccagcatttgtgtggactctcagagatttcaccctggaactggaagtagatggagaacccatcactgctgatgactacttggagctttcgctaaagctaagaaaaggtactgataagaaaagtaaaagctttaatgatcctcggttgtgcatccgaaagttcttccccaagaggaagtgcttcgtcttcgattggcccgctcctaagaagtaccttgctcacctagagcagctaaaggaggaagagctgaaccctgatttcatagaacaagttgcagaattttgttcctacatcctcagccattccaatgtcaagactctttcaggtggcattgcagtcaatgggcctcgtctagagagcctggtgctgacctacgtcaatgccatcagcagtggggatctaccctgcatggagaacgcagtcctggccttggcccagatagagaactcagccgcagtggaaaaggctattgcccactatgaacagcagatgggccagaaggtgcagctgcccacggaaaccctccaggagctgctggacctgcacagggacagtgagagagaggccattgaagtcttcatgaagaactctttcaaggatgtggaccaaatgttccagaggaaattaggggcccagttggaagcaaggcgagatgacttttgtaagcagaattccaaagcatcatcagattgttgcatggctttacttcaggatatatttggccctttagaagaagatgtcaagcagggaacattttctaaaccaggaggttaccgtctctttactcagaagctgcaggagctgaagaataagtactaccaggtgccaaggaaggggatacaggccaaagaggtgctgaaaaaatatttggagtccaaggaggatgtggctgatgcacttctacagactgatcagtcactctcagaaaaggaaaaagcgattgaagtggaacgtataaaggctgaatctgcagaagctgcaaagaaaatgttggaggaaatacaaaagaagaatgaggagatgatggaacagaaagagaagagttatcaggaacatgtgaaacaattgactgagaagatggagagggacagggcccagttaatggcagagcaagagaagaccctcgctcttaaacttcaggaacaggaacgccttctcaaggagggattcgagaatgagagcaagagacttcaaaaagacatatgggatatccagatgagaagcaaatcattggagccaatatgtaacatactctaaaagtccaaggagcaaaatttgcctgtccagctccctctccccaagaaacaacatgaatgagcaacttcagagtgtcaaacaactgccattaaacttaactcaaaatc

SEQ ID NO: 61 - DNA, 739 bp, Homo sapiens
  misc_feature (31)..(31): n is a, c, g, or t/u
  misc_feature (36)..(36): n is a, c, g, or t/u
  misc_feature (71)..(71): n is a, c, g, or t/u
  misc_feature (241)..(241): n is a, c, g, or t/u
  misc_feature (306)..(306): n is a, c, g, or t/u
  misc_feature (375)..(375): n is a, c, g, or t/u
  misc_feature (616)..(616): n is a, c, g, or t/u
  misc_feature (618)..(618): n is a, c, g, or t/u
  misc_feature (675)..(675): n is a, c, g, or t/u
  misc_feature (680)..(680): n is a, c, g, or t/u
  misc_feature (682)..(682): n is a, c, g, or t/u
  misc_feature (688)..(688): n is a, c, g, or t/u
  misc_feature (697)..(697): n is a, c, g, or t/u
  misc_feature (715)..(715): n is a, c, g, or t/u
  misc_feature (723)..(724): n is a, c, g, or t/u
ccgacggcccgctgctggcctccgtgacgcngtctnctccgcgcctcgcggcatggcgtcggaggggccgngggagcccgaaagcgagggcatcaagttatcaggcatatgtcaaaccatttgtccccagatttgccgggctcaatgtggcatggttagagtcctcagaagcatgtgtcttccccagctctgcagccacatactatccgtttgttcaggaaccaccagtgacagaaatgtntactcagtgcctggctcccagtatctttataaccaacccagttgttaccgaggttttcaaacagngaagcatcgaaatgagaacacatgccctctcccacaagaaatgaaagctctgtttaagaagaaaacctntgatgagaaaaaaacgtatgatcagcaaaagtttgacagtgaaagggctgatggaactatatcatctgagataaaatcagctagaggttcacatcatttgtccatttacgctgagaatagtttgaaatcagatggttaccataagcgaacagacaggaaatccagaatcatttgcaaaaaatggatctacctccaaacctgagtttgaatttaccacactggacttttcctgaactgcaangngcaagagaaacaatatgtcataagatccagaaagcaaccccaagtgggggacctggnccacntntggctnttacccganatttctttttttaagaanaagtaggnnaaacccagctgccgt

SEQ ID NO: 62 - DNA, 665 bp, Homo sapiens
  misc_feature (458)..(458): n is a, c, g, or t/u
  misc_feature (474)..(474): n is a, c, g, or t/u
  misc_feature (537)..(537): n is a, c, g, or t/u
  misc_feature (589)..(589): n is a, c, g, or t/u
  misc_feature (609)..(609): n is a, c, g, or t/u
  misc_feature (635)..(635): n is a, c, g, or t/u
gacctttaacaggctccgcagcactgaacgcctgcagacactgcttcatgtgccctttaatgctgatcaatttccagattcaacagttacacaaattacattgtcatgaaaaacagaagaaaaagccccaaagtctttttcagacctcccctccttacccaaaatacagacacacaggcaagaactctcataaattcaaattcatcatttgagaggttgaagcctccaaggattcttctagctccagggtacatccactgtatgcttccagatgttttttccagatttcaatgtagtgtggctcttctttttctttcagggctggggggccatcttctgcagggcagctggggccctgtgtgggtaggctgggaggtgcctgaggcctgggctctcccaccagctcctgctgcacattctccagcatggcttgactggatctttctggtacatacggncttggaaacggaccanttctttgagtagggtcggtaacacaagcatccactttttttactaaagcatctggctgcagtnatccctgaatctgcggctggtggatcttagggaaagggggtgtgattgggancaaaggggggaggcctctgngttcctttggagctctggggcctggnggctttttcaaactttggcctcaacccgaa

SEQ ID NO: 63 - DNA, 1003 bp, Homo sapiens
  misc_feature (548)..(548): n is a, c, g, or t/u
  misc_feature (590)..(590): n is a, c, g, or t/u
  misc_feature (614)..(614): n is a, c, g, or t/u
  misc_feature (633)..(633): n is a, c, g, or t/u
  misc_feature (639)..(639): n is a, c, g, or t/u
  misc_feature (648)..(648): n is a, c, g, or t/u
  misc_feature (658)..(658): n is a, c, g, or t/u
  misc_feature (687)..(687): n is a, c, g, or t/u
  misc_feature (707)..(707): n is a, c, g, or t/u
  misc_feature (710)..(710): n is a, c, g, or t/u
  misc_feature (712)..(712): n is a, c, g, or t/u
  misc_feature (730)..(730): n is a, c, g, or t/u
  misc_feature (735)..(735): n is a, c, g, or t/u
  misc_feature (771)..(771): n is a, c, g, or t/u
  misc_feature (805)..(805): n is a, c, g, or t/u
  misc_feature (813)..(813): n is a, c, g, or t/u
  misc_feature (824)..(824): n is a, c, g, or t/u
  misc_feature (851)..(851): n is a, c, g, or t/u
  misc_feature (862)..(862): n is a, c, g, or t/u
  misc_feature (882)..(882): n is a, c, g, or t/u
  misc_feature (900)..(900): n is a, c, g, or t/u
  misc_feature (913)..(913): n is a, c, g, or t/u
  misc_feature (919)..(919): n is a, c, g, or t/u
  misc_feature (927)..(927): n is a, c, g, or t/u
  misc_feature (929)..(929): n is a, c, g, or t/u
  misc_feature (933)..(933): n is a, c, g, or t/u
  misc_feature (940)..(940): n is a, c, g, or t/u
  misc_feature (977)..(977): n is a, c, g, or t/u
  misc_feature (1000)..(1000): n is a, c, g, or t/u
ccattattgtatataaagaacattgtgacttttaatattagcatttttgctttcaacagcaattagcaatctcttggtttgctgtttggtaaagcatcggttaatgaggtcatctagtttaaaatcccagctacttgaaaataacagggaggaggtcaaatctatcatttcatgttatattctctgctctcttttcagttctctaaagaaaagatatctttgttatccacaataagtcattacgacccgttactggccctctgtgttttactaccacctcaagatacagttaggttctctcttgctgaagtactgaaataggataattcatctaataaacaaacaaacaaaaaaaacaactttgagcatctgaggatgaggaattggtttcgcgttggttgtgttgtctttcctccgacagttctgagttcacgtctagcgaggggttgtctctatggtggaaggggttcccggggtggttgacctcggagtggctgctggtggtgtgtccatcgggctcccagccccgctgttgggcgtgacaaaangaactgactgcaggtgtgtctccctgctggtgggccctgcanggtctgtccacaaaaggtgatggngcttctcccaatctttggnctggcnaaaatggancccccagttntccgggctgtggttacaagcccctggcanggtttcacctcgcttttacnggncnccaattttcaaacaaacntttgncttggaaacccccccggcggattggaaaaacctggncaagtggcggttccccccccccccttgccgtttngggccttnggggaaccggngccctccattttttgggccccctttgngtggggaaacnttgtcggggggcttttcccntccccccttaaaaaaccnggctttttggaanctcccntaattggncngggncctttancctttttggacggcccccccaaattttttttccaaancttctttgggccctttttcaaanccc

SEQ ID NO: 64 - DNA, 765 bp, Homo sapiens
  misc_feature (428)..(428): n is a, c, g, or t/u
  misc_feature (508)..(508): n is a, c, g, or t/u
  misc_feature (518)..(518): n is a, c, g, or t/u
  misc_feature (593)..(593): n is a, c, g, or t/u
  misc_feature (598)..(599): n is a, c, g, or t/u
  misc_feature (608)..(609): n is a, c, g, or t/u
  misc_feature (638)..(638): n is a, c, g, or t/u
  misc_feature (648)..(649): n is a, c, g, or t/u
  misc_feature (651)..(651): n is a, c, g, or t/u
  misc_feature (689)..(689): n is a, c, g, or t/u
  misc_feature (696)..(696): n is a, c, g, or t/u
  misc_feature (705)..(705): n is a, c, g, or t/u
  misc_feature (709)..(709): n is a, c, g, or t/u
  misc_feature (712)..(712): n is a, c, g, or t/u
  misc_feature (732)..(732): n is a, c, g, or t/u
  misc_feature (739)..(739): n is a, c, g, or t/u
  misc_feature (741)..(741): n is a, c, g, or t/u
  misc_feature (747)..(747): n is a, c, g, or t/u
gtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacaagtccaaataacggcttatcctaccagcccaatggcctgcctcaccctaccccacctccacctnagcattaccgtttggatgatatggccattgcccaccactacagggactcctatcgacaccccagccacaggggacctcanggacagaaanagacctatggggttgcatggcacacgtcaagaagaaatgattgatcccagactaacagactgagaatgggcctgnaagannggaaacatnnttgaccattctggttaaactgcataaatnggacatgggnngnaaaaaaacaaagggcgatctttttacccgtacctaaanggcgggnggttcaaanaaancanaacccgggggaagaaatttnaatttcntnggaatncgggggggtaccagtgga

SEQ ID NO: 65 - DNA, 566 bp, Homo sapiens
  misc_feature (36)..(37): n is a, c, g, or t/u
  misc_feature (39)..(39): n is a, c, g, or t/u
  misc_feature (42)..(42): n is a, c, g, or t/u
  misc_feature (44)..(44): n is a, c, g, or t/u
  misc_feature (48)..(48): n is a, c, g, or t/u
  misc_feature (50)..(51): n is a, c, g, or t/u
  misc_feature (55)..(55): n is a, c, g, or t/u
  misc_feature (60)..(60): n is a, c, g, or t/u
  misc_feature (292)..(292): n is a, c, g, or t/u
  misc_feature (339)..(339): n is a, c, g, or t/u
  misc_feature (506)..(506): n is a, c, g, or t/u
  misc_feature (529)..(529): n is a, c, g, or t/u
  misc_feature (544)..(544): n is a, c, g, or t/u
  misc_feature (546)..(546): n is a, c, g, or t/u
  misc_feature (561)..(561): n is a, c, g, or t/u
aaggaccaaggccaagaaggacaaagcccaaagganntntgnanctcncnnccgnggctntgctccccactctgagagtgatctaccagagcaggaagaggagattctgggatctgatgatgatgagcaagaagatcctaatgattattgtaaaggaggttatcatcttgtgaaaattggagatctattcaatgggagataccatgtgatccgaaagttaggctggggacacttttcaacagtatggttatcatgggatattcaggggaagaaatttgtggcaatgaaagtngttaaaagtgctgaacattacactgaaacagcactagatgaaatccngttgctgaagtcagttcgcaattcagaccctaatgatccaaatagagaaatggttgttcaactactagatgactttaaaatatcaggagttaatggaacacatatctgcatggtatttgaagttttggggcatcatctgctcaagtggatcatcaaatccaattatnaggggcttccactgccttgtgtnaaaaaaattattcancnagtgtttacagggtnttgat

SEQ ID NO: 66 - DNA, 445 bp, Homo sapiens
  misc_feature (3)..(3): n is a, c, g, or t/u
  misc_feature (15)..(15): n is a, c, g, or t/u
  misc_feature (33)..(33): n is a, c, g, or t/u
  misc_feature (36)..(36): n is a, c, g, or t/u
  misc_feature (40)..(40): n is a, c, g, or t/u
  misc_feature (45)..(45): n is a, c, g, or t/u
  misc_feature (52)..(52): n is a, c, g, or t/u
  misc_feature (96)..(96): n is a, c, g, or t/u
  misc_feature (112)..(112): n is a, c, g, or t/u
  misc_feature (116)..(116): n is a, c, g, or t/u
  misc_feature (158)..(158): n is a, c, g, or t/u
  misc_feature (212)..(212): n is a, c, g, or t/u
  misc_feature (214)..(214): n is a, c, g, or t/u
  misc_feature (240)..(240): n is a, c, g, or t/u
  misc_feature (258)..(258): n is a, c, g, or t/u
  misc_feature (308)..(308): n is a, c, g, or t/u
  misc_feature (312)..(312): n is a, c, g, or t/u
  misc_feature (370)..(370): n is a, c, g, or t/u
  misc_feature (387)..(387): n is a, c, g, or t/u
gangcagcccggacncagcaagtttaatgtctntgntgtncatanaattaanaccctttccccctcctcatccttatgctggcaataggatatgcnctaaaaaatttgactnttanagtcaatgaataaaaggatgggctcatacaccttcatagctnttttcaaaaaggatgcttataatttaaaggatgtcctaatgggaaggaaaggtncngggcaagaggctgtttcacattttantccattagtctttggcanagcccaaccaaggccaaattcacctaggatgcccaatggctgtggggatntccncagggtcaagtaagcaaacccaaatgaacatgttggattaaaaaaaaaacaagatctnaaaacttttgaaggaanagcttcccctgaaaagggaagaggaaaatgcttgaaggggaagggcggagggtcaatg

SEQ ID NO: 67 - DNA, 976 bp, Homo sapiens
  misc_feature (1)..(1): n is a, c, g, or t/u
  misc_feature (594)..(594): n is a, c, g, or t/u
  misc_feature (617)..(617): n is a, c, g, or t/u
  misc_feature (679)..(679): n is a, c, g, or t/u
  misc_feature (691)..(691): n is a, c, g, or t/u
  misc_feature (699)..(699): n is a, c, g, or t/u
  misc_feature (704)..(704): n is a, c, g, or t/u
  misc_feature (710)..(710): n is a, c, g, or t/u
  misc_feature (725)..(725): n is a, c, g, or t/u
  misc_feature (744)..(744): n is a, c, g, or t/u
  misc_feature (787)..(787): n is a, c, g, or t/u
  misc_feature (804)..(804): n is a, c, g, or t/u
  misc_feature (808)..(808): n is a, c, g, or t/u
  misc_feature (812)..(812): n is a, c, g, or t/u
  misc_feature (836)..(836): n is a, c, g, or t/u
  misc_feature (840)..(840): n is a, c, g, or t/u
  misc_feature (843)..(843): n is a, c, g, or t/u
  misc_feature (845)..(845): n is a, c, g, or t/u
  misc_feature (859)..(859): n is a, c, g, or t/u
  misc_feature (885)..(885): n is a, c, g, or t/u
  misc_feature (903)..(903): n is a, c, g, or t/u
  misc_feature (907)..(907): n is a, c, g, or t/u
  misc_feature (917)..(917): n is a, c, g, or t/u
  misc_feature (922)..(922): n is a, c, g, or t/u
  misc_feature (928)..(928): n is a, c, g, or t/u
  misc_feature (931)..(931): n is a, c, g, or t/u
  misc_feature (933)..(933): n is a, c, g, or t/u
  misc_feature (951)..(951): n is a, c, g, or t/u
  misc_feature (965)..(965): n is a, c, g, or t/u
ntcgcgcgcctgcaggtcgacactagtggatccaaagagagtttgcaaaggaattttggaatatcttacagtggcagaggtggtggagactatggaagatttggtcacttacacaaagaatcttgggccaggaatgactaagatggccaagatgattgacgagagacagcaggagctcactcaccaggagcaccgagtgatgttggtgaactcgatgaacaccgtgaaagagttgctgccagttctcatttcagctatgaagatttttgtaacaactaaaaactcaaaaaaccaaggcatagaggaagctttaaaaaatcgcaattttactgtagaaaaaatgagtgctgaaattaatgagataattcgtgtgttacaactcacctcttgggatgaagatgcctgggccagcaaggacactgaagccatgaagagagcattggcctccatagactccaaactgaaccaggccaaaggttggctccgtgaccctagtgcctccccaggggatgctggtgagcaggccatcagacagatcttagatgaagctggaaaagttggtgaactctgtgcaggcaaaaaacgcagggagantctggggaacttgcaaaatgctngggcagatgactgtcaaagtggcttgacctccgtgccaagaggacaaggatccttacccggngggccatgccanaaaagctnaacanggtatnttcaaggtcttggantgtgctccccagcaaaagnggaaaaagccagcttccaaagctgggaaagccttgcccacttnaaaccaaaacatttgcnaaanaaanaaacgatgcttgtttaaaactggnttgnganantccaaatggggggnccgggaagggaaaaaaacaaatttcnagggcttttggcttgaanctcngaaaataccnaattntttggnggntnctaaaaaaaaaaaagganattttccttccttnggggaaaaatt

SEQ ID NO: 68 - DNA, 487 bp, Homo sapiens
  misc_feature (470)..(470): n is a, c, g, or t/u
aatttgcttcactgtgtctcgagcactgatattggagaaaagcacatccggcataaagtgtaaaccagtgtctcaaaccactggaagaaccgggagagcaaacatgatttttcttatttcctctaagtaatctttctttagtaaaacaacaagtgatctttggcatagattcatactttaaaggcattaatattgcatttatatcaggcaagcaactatacaaatatgctgagggccttgaaaataatcatcctcattataaaggaaatagtgaaagcctgagtgtaaaggaccaacttaagttgtacacattcgatgttgggaactaacacacagcgatgggtgggaaggaaggatgttcaggcaaggttcttactcctttactcatctggttctggctttgggaaaaaataaggtttcatgtgctgggaaatacttagcagtaataagtaccaaaaaggaaacactgncctctcattttgcctag

SEQ ID NO: 69 - DNA, 826 bp, Homo sapiens
  misc_feature (651)..(651): n is a, c, g, or t/u
  misc_feature (719)..(719): n is a, c, g, or t/u
  misc_feature (780)..(780): n is a, c, g, or t/u
  misc_feature (783)..(783): n is a, c, g, or t/u
  misc_feature (791)..(791): n is a, c, g, or t/u
  misc_feature (817)..(817): n is a, c, g, or t/u
  misc_feature (820)..(820): n is a, c, g, or t/u
gcaaaaacttgtgatagaaaattttgatgatgagcagatttggcaacaactggaattgcaaaatgaaccaattttacaatactttcagaatgcagttagtgaaacaattaatgatgaagatatcagtcttctcccagagagtgaagaacaggaacgtgaagaggatggttcagagatagaggctgatgacaaggaggacctagaagatttagaggaggaggaagtgtccgacatgggtaatgatgatcctgaaatgggtgagagagctgaaaactcaagcaaatctgatctgaggaaaagccccgttttcagtgatgaggattctgaccttgactttgatatcagcaaattggaacagcagagcaaggtgcaaaacaaaggacagggaaaaccaagagaaaagtccatagtagatgataaattcttcaaactctctgaaatggaggcctatttagaaaacatagaaaaagaagaggaaccgaaaagatgataatgatgaggaggaggaagatattgatttttttgaagatattgattctgatgaagatgaagggggactgtttggaagtaaaaaacttaagtcaggtaaaagttccagaaatctgaaatacaaagatttttttgatccagtttgaaaagtgatgaagaccntacaaatgttcatgatgatgagctggattcaacccaagaaaatgatgaaatttgctgaagaagaagcngaagaacttagttttttcggaaaccggttgaagatgaatgaccttcaagaaaaatgaaganccnttaaccanccttaaggaaagcttggaaaagaagngancctttg

SEQ ID NO: 70 - DNA, 1015 bp, Homo sapiens
  misc_feature (4)..(4): n is a, c, g, or t/u
  misc_feature (39)..(39): n is a, c, g, or t/u
  misc_feature (55)..(56): n is a, c, g, or t/u
  misc_feature (60)..(60): n is a, c, g, or t/u
  misc_feature (69)..(69): n is a, c, g, or t/u
  misc_feature (71)..(71): n is a, c, g, or t/u
  misc_feature (74)..(74): n is a, c, g, or t/u
  misc_feature (94)..(94): n is a, c, g, or t/u
  misc_feature (109)..(109): n is a, c, g, or t/u
  misc_feature (117)..(117): n is a, c, g, or t/u
  misc_feature (120)..(120): n is a, c, g, or t/u
  misc_feature (133)..(133): n is a, c, g, or t/u
  misc_feature (140)..(140): n is a, c, g, or t/u
  misc_feature (142)..(143): n is a, c, g, or t/u
  misc_feature (145)..(145): n is a, c, g, or t/u
  misc_feature (170)..(170): n is a, c, g, or t/u
  misc_feature (175)..(175): n is a, c, g, or t/u
  misc_feature (181)..(181): n is a, c, g, or t/u
  misc_feature (186)..(186): n is a, c, g, or t/u
  misc_feature (189)..(189): n is a, c, g, or t/u
  misc_feature (191)..(191): n is a, c, g, or t/u
  misc_feature (193)..(193): n is a, c, g, or t/u
  misc_feature (201)..(201): n is a, c, g, or t/u
  misc_feature (211)..(211): n is a, c, g, or t/u
  misc_feature (213)..(213): n is a, c, g, or t/u
  misc_feature (225)..(226): n is a, c, g, or t/u
  misc_feature (230)..(230): n is a, c, g, or t/u
  misc_feature (236)..(236): n is a, c, g, or t/u
  misc_feature (249)..(249): n is a, c, g, or t/u
  misc_feature (252)..(252): n is a, c, g, or t/u
  misc_feature (254)..(254): n is a, c, g, or t/u
  misc_feature (256)..(256): n is a, c, g, or t/u
  misc_feature (274)..(274): n is a, c, g, or t/u
  misc_feature (286)..(287): n is a, c, g, or t/u
  misc_feature (291)..(291): n is a, c, g, or t/u
  misc_feature (298)..(298): n is a, c, g, or t/u
  misc_feature (301)..(301): n is a, c, g, or t/u
  misc_feature (304)..(305): n is a, c, g, or t/u
  misc_feature (317)..(317): n is a, c, g, or t/u
  misc_feature (320)..(320): n is a, c, g, or t/u
  misc_feature (324)..(324): n is a, c, g, or t/u
  misc_feature (326)..(326): n is a, c, g, or t/u
  misc_feature (329)..(329): n is a, c, g, or t/u
  misc_feature (331)..(331): n is a, c, g, or t/u
  misc_feature (338)..(339): n is a, c, g, or t/u
  misc_feature (351)..(351): n is a, c, g, or t/u
  misc_feature (358)..(358): n is a, c, g, or t/u
  misc_feature (371)..(371): n is a, c, g, or t/u
  misc_feature (377)..(377): n is a, c, g, or t/u
  misc_feature (384)..(384): n is a, c, g, or t/u
  misc_feature (390)..(390): n is a, c, g, or t/u
  misc_feature (404)..(404): n is a, c, g, or t/u
  misc_feature (417)..(417): n is a, c, g, or t/u
  misc_feature (429)..(429): n is a, c, g, or t/u
  misc_feature (452)..(452): n is a, c, g, or t/u
  misc_feature (462)..(462): n is a, c, g, or t/u
  misc_feature (471)..(471): n is a, c, g, or t/u
  misc_feature (474)..(474): n is a, c, g, or t/u
  misc_feature (483)..(483): n is a, c, g, or t/u
  misc_feature (501)..(501): n is a, c, g, or t/u
  misc_feature (506)..(506): n is a, c, g, or t/u
  misc_feature (525)..(525): n is a, c, g, or t/u
  misc_feature (548)..(548): n is a, c, g, or t/u
  misc_feature (551)..(551): n is a, c, g, or t/u
  misc_feature (554)..(554): n is a, c, g, or t/u
  misc_feature (556)..(556): n is a, c, g, or t/u
  misc_feature (568)..(568): n is a, c, g, or t/u
  misc_feature (574)..(574): n is a, c, g, or t/u
  misc_feature (599)..(599): n is a, c, g, or t/u
  misc_feature (602)..(602): n is a, c, g, or t/u
  misc_feature (605)..(605): n is a, c, g, or t/u
  misc_feature (623)..(623): n is a, c, g, or t/u
  misc_feature (629)..(630): n is a, c, g, or t/u
  misc_feature (633)..(633): n is a, c, g, or t/u
  misc_feature (649)..(649): n is a, c, g, or t/u
  misc_feature (669)..(669): n is a, c, g, or t/u
  misc_feature (673)..(673): n is a, c, g, or t/u
  misc_feature (685)..(685): n is a, c, g, or t/u
  misc_feature (706)..(706): n is a, c, g, or t/u
  misc_feature (735)..(735): n is a, c, g, or t/u
  misc_feature (755)..(755): n is a, c, g, or t/u
  misc_feature (760)..(760): n is a, c, g, or t/u
  misc_feature (763)..(763): n is a, c, g, or t/u
  misc_feature (766)..(766): n is a, c, g, or t/u
  misc_feature (774)..(775): n is a, c, g, or t/u
  misc_feature (778)..(778): n is a, c, g, or t/u
  misc_feature (782)..(782): n is a, c, g, or t/u
  misc_feature (806)..(806): n is a, c, g, or t/u
  misc_feature (815)..(815): n is a, c, g, or t/u
  misc_feature (828)..(828): n is a, c, g, or t/u
  misc_feature (840)..(840): n is a, c, g, or t/u
  misc_feature (849)..(849): n is a, c, g, or t/u
  misc_feature (855)..(855): n is a, c, g, or t/u
  misc_feature (858)..(858): n is a, c, g, or t/u
  misc_feature (863)..(863): n is a, c, g, or t/u
  misc_feature (868)..(868): n is a, c, g, or t/u
  misc_feature (874)..(874): n is a, c, g, or t/u
  misc_feature (877)..(877): n is a, c, g, or t/u
  misc_feature (879)..(879): n is a, c, g, or t/u
  misc_feature (888)..(888): n is a, c, g, or t/u
  misc_feature (905)..(905): n is a, c, g, or t/u
  misc_feature (911)..(912): n is a, c, g, or t/u
  misc_feature (937)..(937): n is a, c, g, or t/u
  misc_feature (948)..(948): n is a, c, g, or t/u
  misc_feature (966)..(966): n is a, c, g, or t/u
  misc_feature (969)..(969): n is a, c, g, or t/u
  misc_feature (979)..(979): n is a, c, g, or t/u
  misc_feature (996)..(996): n is a, c, g, or t/u
  misc_feature (1006)..(1006): n is a, c, g, or t/u
ggcntcattgatttgcatttttacttgatcttggaattnaaaaaaaaatgcttgnnaggnctttaaggncntgnctttaccttcatcctttatnaaggaagctttgccngttttggncanctgttttaacttntcccaancnncnggtttgctggatttccctgcttganctacnctggtnttttnaancngntttctccncttctccttntnttttattttcanncccntttganatttctttttccntcncncncggttcttggctggagcnggtttttcagcnnctgnttttatntcnccnnctttatttttcnccntgancnccncnggggccnngaaagctgcatnactaacnctcactggggctncttccnccatggntatggntgggaaatttgacncaactttaatctntgggcaggcggnttagggataaaggggaagttganagggcctccnattttaaanaanagggaaccntcatcttctgaatttctncatgnccggattttttcttctggnggttttggcgggggagttgaggnacnccngntcaaaaatttcncaaggngcaaatttactctttttatggggcnaanggnaaaccccttttatattcntatgcnnccnttttagggtttttttncgactacataaccccagccngacntttttctttggnaaaagaaattttccattgaanggggggttctttttaatacaagggccctnccgcaaattgggaaaagggnggggnttntcnaaaagggnnttnttgncccttttgggcgggaccttccccngaagggccngggtttttttaancacttttttttnaaaagaaantttcantanctttncccgncttttnaangnggttaactntcaaattttttttattnaaaccnntttttagttcccttatttgggaaanaaggccttttnaactttttatggggtatnggncatttttgangggaatttttttcgttncaaaataaantttgttttt

SEQ ID NO: 71 - DNA, 1140 bp, Homo sapiens
  misc_feature (2)..(2): n is a, c, g, or t/u
  misc_feature (414)..(414): n is a, c, g, or t/u
  misc_feature (421)..(422): n is a, c, g, or t/u
  misc_feature (462)..(462): n is a, c, g, or t/u
  misc_feature (468)..(468): n is a, c, g, or t/u
  misc_feature (471)..(471): n is a, c, g, or t/u
  misc_feature (506)..(507): n is a, c, g, or t/u
  misc_feature (512)..(512): n is a, c, g, or t/u
  misc_feature (564)..(565): n is a, c, g, or t/u
  misc_feature (568)..(568): n is a, c, g, or t/u
  misc_feature (576)..(576): n is a, c, g, or t/u
  misc_feature (584)..(584): n is a, c, g, or t/u
  misc_feature (613)..(613): n is a, c, g, or t/u
  misc_feature (639)..(640): n is a, c, g, or t/u
  misc_feature (644)..(644): n is a, c, g, or t/u
  misc_feature (668)..(668): n is a, c, g, or t/u
  misc_feature (682)..(682): n is a, c, g, or t/u
  misc_feature (687)..(687): n is a, c, g, or t/u
  misc_feature (693)..(693): n is a, c, g, or t/u
  misc_feature (699)..(699): n is a, c, g, or t/u
  misc_feature (703)..(703): n is a, c, g, or t/u
  misc_feature (713)..(714): n is a, c, g, or t/u
  misc_feature (732)..(732): n is a, c, g, or t/u
  misc_feature (743)..(743): n is a, c, g, or t/u
  misc_feature (748)..(749): n is a, c, g, or t/u
  misc_feature (755)..(755): n is a, c, g, or t/u
  misc_feature (757)..(757): n is a, c, g, or t/u
  misc_feature (759)..(759): n is a, c, g, or t/u
  misc_feature (766)..(766): n is a, c, g, or t/u
  misc_feature (768)..(768): n is a, c, g, or t/u
  misc_feature (774)..(774): n is a, c, g, or t/u
  misc_feature (787)..(787): n is a, c, g, or t/u
  misc_feature (794)..(794): n is a, c, g, or t/u
  misc_feature (803)..(804): n is a, c, g, or t/u
  misc_feature (809)..(809): n is a, c, g, or t/u
  misc_feature (817)..(818): n is a, c, g, or t/u
  misc_feature (824)..(824): n is a, c, g, or t/u
  misc_feature (826)..(826): n is a, c, g, or t/u
  misc_feature (830)..(830): n is a, c, g, or t/u
  misc_feature (832)..(832): n is a, c, g, or t/u
  misc_feature (843)..(843): n is a, c, g, or t/u
  misc_feature (845)..(845): n is a, c, g, or t/u
  misc_feature (850)..(851): n is a, c, g, or t/u
  misc_feature (859)..(859): n is a, c, g, or t/u
  misc_feature (862)..(862): n is a, c, g, or t/u
  misc_feature (898)..(898): n is a, c, g, or t/u
  misc_feature (903)..(903): n is a, c, g, or t/u
  misc_feature (906)..(906): n is a, c, g, or t/u
  misc_feature (909)..(909): n is a, c, g, or t/u
  misc_feature (917)..(917): n is a, c, g, or t/u
  misc_feature (926)..(926): n is a, c, g, or t/u
  misc_feature (941)..(941): n is a, c, g, or t/u
  misc_feature (948)..(948): n is a, c, g, or t/u
  misc_feature (953)..(954): n is a, c, g, or t/u
  misc_feature (964)..(964): n is a, c, g, or t/u
  misc_feature (967)..(967): n is a, c, g, or t/u
  misc_feature (974)..(974): n is a, c, g, or t/u
  misc_feature (981)..(981): n is a, c, g, or t/u
  misc_feature (1000)..(1000): n is a, c, g, or t/u
  misc_feature (1029)..(1030): n is a, c, g, or t/u
  misc_feature (1040)..(1040): n is a, c, g, or t/u
  misc_feature (1043)..(1043): n is a, c, g, or t/u
  misc_feature (1048)..(1048): n is a, c, g, or t/u
  misc_feature (1052)..(1052): n is a, c, g, or t/u
  misc_feature (1059)..(1059): n is a, c, g, or t/u
  misc_feature (1086)..(1086): n is a, c, g, or t/u
  misc_feature (1088)..(1088): n is a, c, g, or t/u
  misc_feature (1091)..(1091): n is a, c, g, or t/u
  misc_feature (1095)..(1095): n is a, c, g, or t/u
  misc_feature (1099)..(1099): n is a, c, g, or t/u
  misc_feature (1101)..(1101): n is a, c, g, or t/u
  misc_feature (1116)..(1116): n is a, c, g, or t/u
  misc_feature (1127)..(1128): n is a, c, g, or t/u
  misc_feature (1130)..(1130): n is a, c, g, or t/u
  misc_feature (1135)..(1135): n is a, c, g, or t/u
tnccgcgcctgcaggtcgacactagtggatccaaagaattcggcaccagattttgtcacgtggggacccagctgtacatatgtggataagctgattaatggttttgcaactgtaatagtagctgtatcgttctaatgcagacattggatttggtgactgtctcattgtgccatgaggtaaatgtaatgtttcaggcattctgcttgcaaaaaaatctatcatgtgcttttctagatgtctctggttctatagtgcaaatgcttttattagccaataggaattttaaaataacatggaacttacacaaaaggcttttcatgtgccttacttttttaaaaaggagtttattgtattcattggaatatgtgacgtaagcaataaagggaatgttagacgtgttaaaaaaaaaaacanaaaacannaaaacaaaaaaaatcctcgaaagtcttttagagcggccgngggccnatngatttttccccccgggtggggtaccaggtaagtgnncccantttcccctatagggagccgtattacaattcactggccgtcgttttacaacgnncgngacttggnaaaaaccntggcgttacccaactttaatcgcctttgnaaacatccccctttcgccagctgggnntaanaacgaaaaaggcccccccgaatcncctttccaaacaanttgcnccaccntggatngggnaatgggaaannccaatttttaaaggggtntaatgggggtnaaacnnccggantncnaattggntngggggnttttaaaaatcancaacccnaagggcttnntttanggcccccnnagtccncncagntntggttaatggncnttaanncccccttnccnaattttgtaaaagggtttttcttggtttaaaaaaancctcncanccnttcccctngaacctganaaaattaaaaaaganaggcccnttggnngtgtgtaaanttngtttttnccccttntaaagggtccccaaaaaancttaccttccaaattttcccaaaataaanntttttttccngcntttcnatgnggggggngcccaccacacaaaggatttttacccnanatntttnccgnantttttttaaaaaccntaaaatttgtnnanacacnttttt

SEQ ID NO: 72 - DNA, 588 bp, Homo sapiens
  misc_feature (7)..(7): n is a, c, g, or t/u
  misc_feature (33)..(33): n is a, c, g, or t/u
  misc_feature (79)..(79): n is a, c, g, or t/u
  misc_feature (96)..(96): n is a, c, g, or t/u
  misc_feature (127)..(127): n is a, c, g, or t/u
  misc_feature (141)..(141): n is a, c, g, or t/u
  misc_feature (153)..(153): n is a, c, g, or t/u
  misc_feature (158)..(158): n is a, c, g, or t/u
  misc_feature (161)..(161): n is a, c, g, or t/u
  misc_feature (166)..(166): n is a, c, g, or t/u
  misc_feature (169)..(169): n is a, c, g, or t/u
  misc_feature (176)..(176): n is a, c, g, or t/u
  misc_feature (183)..(183): n is a, c, g, or t/u
  misc_feature (200)..(200): n is a, c, g, or t/u
  misc_feature (245)..(245): n is a, c, g, or t/u
  misc_feature (260)..(260): n is a, c, g, or t/u
  misc_feature (268)..(268): n is a, c, g, or t/u
  misc_feature (291)..(292): n is a, c, g, or t/u
  misc_feature (310)..(310): n is a, c, g, or t/u
  misc_feature (317)..(317): n is a, c, g, or t/u
  misc_feature (329)..(329): n is a, c, g, or t/u
  misc_feature (355)..(355): n is a, c, g, or t/u
  misc_feature (364)..(364): n is a, c, g, or t/u
  misc_feature (374)..(374): n is a, c, g, or t/u
  misc_feature (397)..(397): n is a, c, g, or t/u
  misc_feature (401)..(401): n is a, c, g, or t/u
  misc_feature (416)..(416): n is a, c, g, or t/u
  misc_feature (427)..(429): n is a, c, g, or t/u
  misc_feature (437)..(437): n is a, c, g, or t/u
  misc_feature (444)..(444): n is a, c, g, or t/u
  misc_feature (453)..(453): n is a, c, g, or t/u
  misc_feature (455)..(455): n is a, c, g, or t/u
  misc_feature (458)..(458): n is a, c, g, or t/u
  misc_feature (474)..(474): n is a, c, g, or t/u
  misc_feature (479)..(479): n is a, c, g, or t/u
  misc_feature (481)..(481): n is a, c, g, or t/u
  misc_feature (483)..(483): n is a, c, g, or t/u
  misc_feature (488)..(488): n is a, c, g, or t/u
  misc_feature (497)..(498): n is a, c, g, or t/u
  misc_feature (501)..(501): n is a, c, g, or t/u
  misc_feature (508)..(509): n is a, c, g, or t/u
  misc_feature (513)..(513): n is a, c, g, or t/u
  misc_feature (515)..(515): n is a, c, g, or t/u
  misc_feature (533)..(533): n is a, c, g, or t/u
  misc_feature (553)..(553): n is a, c, g, or t/u
  misc_feature (556)..(557): n is a, c, g, or t/u
  misc_feature (573)..(573): n is a, c, g, or t/u
  misc_feature (579)..(579): n is a, c, g, or t/u
  misc_feature (584)..(585): n is a, c, g, or t/u
acacgtntaacattccctttattgcttacgtcncatattccaatgaatacaataaactcctttttaaaaaagtaaggcncatgaaaagccttttgngtaagttccatgttattttaaaattcctatnggctaataaaagcntttgcactatanaaccnganacatntanaaaagcncatgatngatttttttgcaagcanaatgcctgaaacattacatttaccttatggcacaatgagacagtnaccaaatccaatgtntgcattanaacgatacagctacttttacagnngcgaaaccattaattagnttatccncatatgtacagntgggtccccacgtgacaaaatctggngccgaattntttggatccnctaatgtcgaccctgcaggcgcncgangctccaagcttttgntccccttttannngagggttnattttcnagcttggcntnatnaaggggaatagcttgnttctngngngaaantgttattcnntcnccaattnncacncnataataccaagcccgggnagttataaaagtggtataanccnnggggtgccctaattgnggtgancttannctc

SEQ ID NO: 73 - DNA, 526 bp, Homo sapiens
  misc_feature (142)..(144): n is a, c, g, or t/u
  misc_feature (148)..(152): n is a, c, g, or t/u
  misc_feature (154)..(154): n is a, c, g, or t/u
  misc_feature (157)..(160): n is a, c, g, or t/u
  misc_feature (162)..(162): n is a, c, g, or t/u
  misc_feature (164)..(166): n is a, c, g, or t/u
  misc_feature (168)..(172): n is a, c, g, or t/u
  misc_feature (176)..(179): n is a, c, g, or t/u
  misc_feature (182)..(182): n is a, c, g, or t/u
  misc_feature (185)..(185): n is a, c, g, or t/u
  misc_feature (187)..(187): n is a, c, g, or t/u
  misc_feature (189)..(190): n is a, c, g, or t/u
  misc_feature (193)..(196): n is a, c, g, or t/u
  misc_feature (201)..(201): n is a, c, g, or t/u
  misc_feature (204)..(204): n is a, c, g, or t/u
  misc_feature (207)..(207): n is a, c, g, or t/u
  misc_feature (210)..(210): n is a, c, g, or t/u
  misc_feature (214)..(214): n is a, c, g, or t/u
  misc_feature (224)..(225): n is a, c, g, or t/u
  misc_feature (231)..(231): n is a, c, g, or t/u
  misc_feature (241)..(241): n is a, c, g, or t/u
  misc_feature (249)..(249): n is a, c, g, or t/u
  misc_feature (253)..(253): n is a, c, g, or t/u
  misc_feature (256)..(256): n is a, c, g, or t/u
  misc_feature (258)..(260): n is a, c, g, or t/u
  misc_feature (271)..(271): n is a, c, g, or t/u
  misc_feature (274)..(274): n is a, c, g, or t/u
  misc_feature (281)..(281): n is a, c, g, or t/u
  misc_feature (292)..(292): n is a, c, g, or t/u
  misc_feature (298)..(298): n is a, c, g, or t/u
  misc_feature (308)..(308): n is a, c, g, or t/u
  misc_feature (315)..(316): n is a, c, g, or t/u
  misc_feature (320)..(320): n is a, c, g, or t/u
  misc_feature (324)..(324): n is a, c, g, or t/u
  misc_feature (331)..(332): n is a, c, g, or t/u
  misc_feature (334)..(334): n is a, c, g, or t/u
  misc_feature (339)..(339): n is a, c, g, or t/u
  misc_feature (342)..(342): n is a, c, g, or t/u
  misc_feature (344)..(344): n is a, c, g, or t/u
  misc_feature (346)..(347): n is a, c, g, or t/u
  misc_feature (350)..(350): n is a, c, g, or t/u
  misc_feature (362)..(362): n is a, c, g, or t/u
  misc_feature (364)..(364): n is a, c, g, or t/u
  misc_feature (368)..(368): n is a, c, g, or t/u
  misc_feature (371)..(371): n is a, c, g, or t/u
  misc_feature (375)..(376): n is a, c, g, or t/u
  misc_feature (379)..(379): n is a, c, g, or t/u
  misc_feature (386)..(387): n is a, c, g, or t/u
  misc_feature (393)..(393): n is a, c, g, or t/u
  misc_feature (395)..(395): n is a, c, g, or t/u
  misc_feature (397)..(398): n is a, c, g, or t/u
  misc_feature (402)..(402): n is a, c, g, or t/u
  misc_feature (406)..(406): n is a, c, g, or t/u
  misc_feature (409)..(409): n is a, c, g, or t/u
  misc_feature (411)..(412): n is a, c, g, or t/u
  misc_feature (414)..(414): n is a, c, g, or t/u
  misc_feature (416)..(416): n is a, c, g, or t/u
  misc_feature (419)..(419): n is a, c, g, or t/u
  misc_feature (422)..(422): n is a, c, g, or t/u
  misc_feature (424)..(424): n is a, c, g, or t/u
  misc_feature (426)..(426): n is a, c, g, or t/u
  misc_feature (431)..(434): n is a, c, g, or t/u
  misc_feature (436)..(437): n is a, c, g, or t/u
  misc_feature (441)..(441): n is a, c, g, or t/u
  misc_feature (443)..(445): n is a, c, g, or t/u
  misc_feature (448)..(448): n is a, c, g, or t/u
  misc_feature (453)..(453): n is a, c, g, or t/u
  misc_feature (455)..(455): n is a, c, g, or t/u
  misc_feature (457)..(459): n is a, c, g, or t/u
  misc_feature (474)..(474): n is a, c, g, or t/u
  misc_feature (479)..(479): n is a, c, g, or t/u
  misc_feature (481)..(482): n is a, c, g, or t/u
  misc_feature (485)..(485): n is a, c, g, or t/u
  misc_feature (487)..(487): n is a, c, g, or t/u
  misc_feature (490)..(490): n is a, c, g, or t/u
  misc_feature (493)..(493): n is a, c, g, or t/u
  misc_feature (495)..(495): n is a, c, g, or t/u
  misc_feature (497)..(497): n is a, c, g, or t/u
  misc_feature (499)..(499): n is a, c, g, or t/u
  misc_feature (502)..(502): n is a, c, g, or t/u
  misc_feature (504)..(504): n is a, c, g, or t/u
  misc_feature (507)..(507): n is a, c, g, or t/u
  misc_feature (512)..(512): n is a, c, g, or t/u
  misc_feature (517)..(518): n is a, c, g, or t/u
  misc_feature (522)..(522): n is a, c, g, or t/u
cccacttctcgctgctcatgccgctgggactggggcggcggaaaaaggcgccccctctagtggaaaatgaggaggctgagccaggccgtggagggctgggcgtgggggagccagggcctctgggcggaggtgggtcgggggnnnaacnnnnnanatnnnncngnnngnnnnncctnnnnttntanangnnttnnnngatanganctnctnttangacgaggatnnataatnctaatgctanaactcctnctanctngnnnggaattgatcntangatggcntatgcaaatangaagtntcattctggnttgatgnntggnggcntaactanngnattancangngnnaantttttctgggtntnctanganattnnganaaaatannggcttngnannctanggcnatnanntntnatnacnanancctannnngnntttntnnnganaagtntngnnnggaatgggattttgnctgcntnngangntangcntncngnggntnttngaccntttcnngaangaat

SEQ ID NO: 74 - DNA, 608 bp, Homo sapiens; identical to SEQ ID NO: 5
  misc_feature (150)..(150): n is a, c, g, or t/u
  misc_feature (175)..(175): n is a, c, g, or t/u
  misc_feature (281)..(281): n is a, c, g, or t/u
  misc_feature (525)..(525): n is a, c, g, or t/u
  misc_feature (547)..(547): n is a, c, g, or t/u
  misc_feature (567)..(567): n is a, c, g, or t/u
  misc_feature (576)..(576): n is a, c, g, or t/u
  misc_feature (578)..(578): n is a, c, g, or t/u
  misc_feature (581)..(581): n is a, c, g, or t/u

SEQ ID NO: 75 - DNA, 891 bp, Homo sapiens
  misc_feature (591)..(591): n is a, c, g, or t/u
  misc_feature (628)..(628): n is a, c, g, or t/u
  misc_feature (652)..(652): n is a, c, g, or t/u
  misc_feature (676)..(676): n is a, c, g, or t/u
  misc_feature (708)..(708): n is a, c, g, or t/u
  misc_feature (710)..(710): n is a, c, g, or t/u
  misc_feature (735)..(735): n is a, c, g, or t/u
  misc_feature (750)..(750): n is a, c, g, or t/u
  misc_feature (782)..(782): n is a, c, g, or t/u
  misc_feature (811)..(811): n is a, c, g, or t/u
  misc_feature (835)..(835): n is a, c, g, or t/u
  misc_feature (865)..(865): n is a, c, g, or t/u
  misc_feature (870)..(870): n is a, c, g, or t/u
  misc_feature (876)..(876): n is a, c, g, or t/u
  misc_feature (881)..(881): n is a, c, g, or t/u
gtctggtgccagcagccgcggtaattccagctccaatagcgtatattaaagttgctgcagttaaaaagctcgtagttggatcttgggagcgggcgggcggtccgccgcgaggcgagccaccgcccgtccccgccccttgcctctcggcgccccctcgatgctcttagctgagtgtcccgcggggcccgaagcgtttactttgaaaaaattagagtgttcaaagcaggcccgagccgcctggataccgcagctaggaataatggaataggaccgcggttctattttgttggttttcggaactgaggccatgattaagagggacggccgggggcattcgtattgcgccgctagaggtgaaattcttggaccggcgcaagacggaccagagcgaaagcatttgccaagaatgttttcattaatcaagaacgaaagtcggaggttcgaagacgatcagataccgtcgtagttccgaccataaacgatgccgaccggcgatgcggcggcgttattcccatgacccgccgggcagcttccccgaaccggtgacggtgtcgtggaactaagcccctgaccagcggcgtgcacaccttnccgggtgtcctacaagtctcaggactctattcctcancaacgtggtgaccgtgcccttcanagcttgggcacccaaacctacatntgcaacgtgaatacaaacccagcaacaccaangngggcaagaaaagttgaaccccaatnttgtgaaaaaaactnacaacatgcccacccgggcccagaacctgaantcttgggggggaccgtaagttttcttttnccccaaaacccaaggacacccttntgatttcccggaccctgaggtacattcctngtggnggaccnaaccnccaaaacctt

SEQ ID NO: 76 - DNA, 1046 bp, Homo sapiens
  misc_feature (3)..(3): n is a, c, g, or t/u
  misc_feature (5)..(5): n is a, c, g, or t/u
  misc_feature (9)..(9): n is a, c, g, or t/u
  misc_feature (13)..(14): n is a, c, g, or t/u
  misc_feature (19)..(19): n is a, c, g, or t/u
  misc_feature (22)..(23): n is a, c, g, or t/u
  misc_feature (39)..(39): n is a, c, g, or t/u
  misc_feature (41)..(41): n is a, c, g, or t/u
  misc_feature (43)..(43): n is a, c, g, or t/u
  misc_feature (46)..(46): n is a, c, g, or t/u
  misc_feature (54)..(54): n is a, c, g, or t/u
  misc_feature (57)..(57): n is a, c, g, or t/u
  misc_feature (60)..(61): n is a, c, g, or t/u
  misc_feature (66)..(66): n is a, c, g, or t/u
  misc_feature (73)..(73): n is a, c, g, or t/u
  misc_feature (80)..(80): n is a, c, g, or t/u
  misc_feature (84)..(84): n is a, c, g, or t/u
  misc_feature (87)..(88): n is a, c, g, or t/u
  misc_feature (91)..(91): n is a, c, g, or t/u
  misc_feature (94)..(94): n is a, c, g, or t/u
  misc_feature (102)..(102): n is a, c, g, or t/u
  misc_feature (121)..(121): n is a, c, g, or t/u
  misc_feature (133)..(133): n is a, c, g, or t/u
  misc_feature (135)..(136): n is a, c, g, or t/u
  misc_feature (156)..(157): n is a, c, g, or t/u
  misc_feature (161)..(162): n is a, c, g, or t/u
  misc_feature (172)..(172): n is a, c, g, or t/u
  misc_feature (179)..(179): n is a, c, g, or t/u
  misc_feature (183)..(183): n is a, c, g, or t/u
  misc_feature (192)..(192): n is a, c, g, or t/u
  misc_feature (200)..(200): n is a, c, g, or t/u
  misc_feature (205)..(208): n is a, c, g, or t/u
  misc_feature (222)..(222): n is a, c, g, or t/u
  misc_feature (226)..(226): n is a, c, g, or t/u
  misc_feature (232)..(233): n is a, c, g, or t/u
  misc_feature (248)..(248): n is a, c, g, or t/u
  misc_feature (250)..(250): n is a, c, g, or t/u
  misc_feature (252)..(252): n is a, c, g, or t/u
  misc_feature (256)..(257): n is a, c, g, or t/u
  misc_feature (261)..(262): n is a, c, g, or t/u
  misc_feature (270)..(270): n is a, c, g, or t/u
  misc_feature (273)..(274): n is a, c, g, or t/u
  misc_feature (278)..(278): n is a, c, g, or t/u
  misc_feature (280)..(280): n is a, c, g, or t/u
  misc_feature (282)..(282): n is a, c, g, or t/u
  misc_feature (287)..(287): n is a, c, g, or t/u
  misc_feature (291)..(291): n is a, c, g, or t/u
  misc_feature (304)..(304): n is a, c, g, or t/u
  misc_feature (311)..(311): n is a, c, g, or t/u
  misc_feature (314)..(314): n is a, c, g, or t/u
  misc_feature (317)..(318): n is a, c, g, or t/u
  misc_feature (327)..(329): n is a, c, g, or t/u
  misc_feature (337)..(337): n is a, c, g, or t/u
  misc_feature (341)..(341): n is a, c, g, or t/u
  misc_feature (347)..(347): n is a, c, g, or t/u
  misc_feature (351)..(351): n is a, c, g, or t/u
  misc_feature (353)..(353): n is a, c, g, or t/u
  misc_feature (355)..(355): n is a, c, g, or t/u
  misc_feature (361)..(362): n is a, c, g, or t/u
  misc_feature (369)..(369): n is a, c, g, or t/u
  misc_feature (371)..(371): n is a, c, g, or t/u
  misc_feature (384)..(384): n is a, c, g, or t/u
  misc_feature (387)..(387): n is a, c, g, or t/u
  misc_feature (396)..(396): n is a, c, g, or t/u
  misc_feature (398)..(400): n is a, c, g, or t/u
  misc_feature (402)..(402): n is a, c, g, or t/u
  misc_feature (420)..(420): n is a, c, g, or t/u
  misc_feature (425)..(425): n is a, c, g, or t/u
  misc_feature (428)..(428): n is a, c, g, or t/u
  misc_feature (432)..(432): n is a, c, g, or t/u
  misc_feature (434)..(434): n is a, c, g, or t/u
  misc_feature (441)..(441): n is a, c, g, or t/u
  misc_feature (448)..(449): n is a, c, g, or t/u
  misc_feature (451)..(451): n is a, c, g, or t/u
  misc_feature (464)..(464): n is a, c, g, or t/u
  misc_feature (468)..(468): n is a, c, g, or t/u
  misc_feature (470)..(470): n is a, c, g, or t/u
  misc_feature (472)..(472): n is a, c, g, or t/u
  misc_feature (480)..(483): n is a, c, g, or t/u
  misc_feature (491)..(491): n is a, c, g, or t/u
  misc_feature (495)..(495): n is a, c, g, or t/u
  misc_feature (498)..(499): n is a, c, g, or t/u
  misc_feature (508)..(509): n is a, c, g, or t/u
  misc_feature (516)..(517): n is a, c, g, or t/u
  misc_feature (522)..(522): n is a, c, g, or t/u
  misc_feature (524)..(524): n is a, c, g, or t/u
  misc_feature (527)..(527): n is a, c, g, or t/u
  misc_feature (529)..(531): n is a, c, g, or t/u
  misc_feature (535)..(535): n is a, c, g, or t/u
  misc_feature (543)..(544): n is a, c, g, or t/u
  misc_feature (551)..(551): n is a, c, g, or t/u
  misc_feature (554)..(554): n is a, c, g, or t/u
  misc_feature (557)..(559): n is a, c, g, or t/u
  misc_feature (563)..(563): n is a, c, g, or t/u
  misc_feature (566)..(567): n is a, c, g, or t/u
  misc_feature (576)..(576): n is a, c, g, or t/u
  misc_feature (582)..(582): n is a, c, g, or t/u
  misc_feature (585)..(585): n is a, c, g, or t/u
  misc_feature (589)..(590): n is a, c, g, or t/u
  misc_feature (594)..(594): n is a, c, g, or t/u
  misc_feature (598)..(598): n is a, c, g, or t/u
  misc_feature (600)..(600): n is a, c, g, or t/u
  misc_feature (606)..(606): n is a, c, g, or t/u
  misc_feature (624)..(624): n is a, c, g, or t/u
  misc_feature (631)..(631): n is a, c, g, or t/u
  misc_feature (647)..(648): n is a, c, g, or t/u
  misc_feature (656)..(656): n is a, c, g, or t/u
  misc_feature (658)..(658): n is a, c, g, or t/u
  misc_feature (661)..(661): n is a, c, g, or t/u
  misc_feature (677)..(678): n is a, c, g, or t/u
  misc_feature (690)..(690): n is a, c, g, or t/u
  misc_feature (707)..(707): n is a, c, g, or t/u
  misc_feature (714)..(714): n is a, c, g, or t/u
  misc_feature (718)..(718): n is a, c, g, or t/u
  misc_feature (723)..(724): n is a, c, g, or t/u
  misc_feature (728)..(728): n is a, c, g, or t/u
  misc_feature (742)..(742): n is a, c, g, or t/u
  misc_feature (747)..(747): n is a, c, g, or t/u
  misc_feature (758)..(758): n is a, c, g, or t/u
  misc_feature (768)..(768): n is a, c, g, or t/u
  misc_feature (787)..(787): n is a, c, g, or t/u
  misc_feature (793)..(793): n is a, c, g, or t/u
  misc_feature (798)..(798): n is a, c, g, or t/u
  misc_feature (808)..(808): n is a, c, g, or t/u
  misc_feature (820)..(820): n is a, c, g, or t/u
  misc_feature (822)..(822): n is a, c, g, or t/u
  misc_feature (824)..(824): n is a, c, g, or t/u
  misc_feature (830)..(830): n is a, c, g, or t/u
  misc_feature (844)..(844): n is a, c, g, or t/u
  misc_feature (852)..(852): n is a, c, g, or t/u
  misc_feature (855)..(856): n is a, c, g, or t/u
  misc_feature (886)..(886): n is a, c, g, or t/u
  misc_feature (893)..(893): n is a, c, g, or t/u
  misc_feature (897)..(897): n is a, c, g, or t/u
  misc_feature (905)..(905): n is a, c, g, or t/u
  misc_feature (914)..(914): n is a, c, g, or t/u
  misc_feature (919)..(919): n is a, c, g, or t/u
  misc_feature (926)..(926): n is a, c, g, or t/u
  misc_feature (929)..(929): n is a, c, g, or t/u
  misc_feature (932)..(932): n is a, c, g, or t/u
  misc_feature (937)..(937): n is a, c, g, or t/u
  misc_feature (958)..(958): n is a, c, g, or t/u
  misc_feature (977)..(977): n is a, c, g, or t/u
  misc_feature (983)..(983): n is a, c, g, or t/u
  misc_feature (990)..(991): n is a, c, g, or t/u
  misc_feature (997)..(997): n is a, c, g, or t/u
  misc_feature (999)..(1002): n is a, c, g, or t/u
  misc_feature (1004)..(1004): n is a, c, g, or t/u
  misc_feature (1017)..(1017): n is a, c, g, or t/u
  misc_feature (1024)..(1024): n is a, c, g, or t/u
  misc_feature (1032)..(1032): n is a, c, g, or t/u
  misc_feature (1041)..(1041): n is a, c, g, or t/u
ccncngggncccnnggcangcnngggggctttttttccntncnggncccccggnaanatnnccccngggggangggccancccnccnnccnccnccataaanccccggggggggggggttngccggccttccntnntttttccccggaaacggggnngggnntttttgaggnaaggggntggncaaaccctntcctttanggggnnnnaaaaaattttcccntggngccccnnttttttccccggggngntntttnnaaannaaaaaggnccnngggncncncagcngggngggggggttttanttttttnccngcnngcctttgtnnncccactcngggngatgtnggtngnanaaaacnnttttccnangcgggggaaggcncanccttttttngnnncncacccccaaagggggggnggggnggncccntngggggtncgggggnngnccttttggttttnaaanangnttttttannnngggggctngggnggnntttttgggnnccccatnnatttntnccntnnnccanttaaccannttgtggnccnggnnngggnaanncccttcccnccgggnacnggcnnttgnctcntncccccnggctttttttttggtttnagacctnccgcccccccccaccnnagggaatnanccntggggtttttggggtnncccccccccccnttttccccgggggggcnggaaaanacangggcnntttnttttggggggaaanaaaanaaccgcccccnaaaaaaatgntttgccccgggggccttanattttncccanattgggcccntttttttccccntngngtgtgnggggtgggaacccngcaaaaanggnngggccccttttgggggcccccccccctttngggggcnatgntttggccngggcccccngaagntcccccnggnggnccccnaaaaaaacccccctttttaancccgggggaagaaaaaccnccgggnggggggnnttttgngnnnnangggaaattttccnccccctntttttaanaacctcccnctcct

SEQ ID NO: 77 - DNA, 636 bp, Homo sapiens
  misc_feature (36)..(36): n is a, c, g, or t/u
  misc_feature (171)..(171): n is a, c, g, or t/u
  misc_feature (177)..(177): n is a, c, g, or t/u
  misc_feature (179)..(179): n is a, c, g, or t/u
  misc_feature (468)..(468): n is a, c, g, or t/u
  misc_feature (555)..(555): n is a, c, g, or t/u
  misc_feature (587)..(587): n is a, c, g, or t/u
ggaagatggcggctgggttcaaaaccgtggaacctntggagtattacaggagatttctgaaagagaactgccgtcctgatggaagagaacttggtgaattcagaaccacaactgtcaacatcggttcaattagtaccgcagatggttctgctttagtgaagttgggaaatnctacantnatctgtggagttaaagcagaatttgcagcaccatcaacagatgcccctgataaaggatacgttgttcctaatgtggatctaccacccctgtgttcatcgagattccggtctggacctcctggagaagaggcccaagtggctagccaattcattgcagatgtcattgaaaattcacagataattcagaaagaggacttatgcatttctccaggaaagcttgtctgggttctatactgtgatctcatttgcctcgactacgatggaaacattttggatgcctgcacatttnctttgctagcggctttaaaaaatgtacaagttgccttgaagttactataaatgaagaaactgctttagccagaagttaatttaaagnaagaaaagttatttgaatattaagaactcatncagttggcaacttcccttttgctggggttttggatgacacttttggctt

SEQ ID NO: 78 - DNA, 687 bp, Homo sapiens
  misc_feature (228)..(228): n is a, c, g, or t/u
  misc_feature (235)..(235): n is a, c, g, or t/u
  misc_feature (564)..(564): n is a, c, g, or t/u
  misc_feature (583)..(583): n is a, c, g, or t/u
  misc_feature (595)..(595): n is a, c, g, or t/u
  misc_feature (638)..(638): n is a, c, g, or t/u
  misc_feature (641)..(641): n is a, c, g, or t/u
  misc_feature (658)..(658): n is a, c, g, or t/u
  misc_feature (683)..(683): n is a, c, g, or t/u
cagaagaatgtagtttgatatttatttagtataaaacgtttgtgcacagtgttaacaaatacaatttttacaaatctgttttgaaaatgtggtggctgtttatttgggtttcatactcttaattacttcatccatcagttttttaacttctttgtgtcttgtaactgctcggctcatacagtcctgaagtttagctccagttagcccacttccacctggtttgtgaanacaacanagtttgccttcctcatccattactattgttaaggttcctgttgccagatgttcctcctctccagtagggtcaactataagcaaagtgtcatcaaacacagcaaaggaagttgcaactggatgagttctaatattcaaataacttttcttctttaaattaacttctgctaaagcagtttcttcatttatagtaacttcaggcaactgtcattttttaaagccgctacaaagcaaatgtgcaggcatccaaaatgtttccatcgtagtcgaggcaaatgagatcacagtatagaacccaaacaagctttcctggaaaaatgcataagtccntctttctgaaatatctggngaattttcaatngacatctgcaatggaattggctagccccttgggcctttctccnganggccaaccgggaatctnatgaaacccaggggggggagatccncatt

SEQ ID NO: 79 - DNA, 1235 bp, Homo sapiens
  misc_feature (10)..(10): n is a, c, g, or t/u
  misc_feature (55)..(56): n is a, c, g, or t/u
  misc_feature (70)..(71): n is a, c, g, or t/u
  misc_feature (74)..(74): n is a, c, g, or t/u
  misc_feature (85)..(85): n is a, c, g, or t/u
  misc_feature (91)..(91): n is a, c, g, or t/u
  misc_feature (141)..(141): n is a, c, g, or t/u
  misc_feature (147)..(147): n is a, c, g, or t/u
  misc_feature (172)..(173): n is a, c, g, or t/u
  misc_feature (181)..(182): n is a, c, g, or t/u
  misc_feature (189)..(191): n is a, c, g, or t/u
  misc_feature (200)..(200): n is a, c, g, or t/u
  misc_feature (235)..(235): n is a, c, g, or t/u
  misc_feature (240)..(243): n is a, c, g, or t/u
  misc_feature (250)..(250): n is a, c, g, or t/u
  misc_feature (255)..(255): n is a, c, g, or t/u
  misc_feature (258)..(258): n is a, c, g, or t/u
  misc_feature (260)..(260): n is a, c, g, or t/u
  misc_feature (283)..(283): n is a, c, g, or t/u
  misc_feature (308)..(308): n is a, c, g, or t/u
  misc_feature (336)..(336): n is a, c, g, or t/u
  misc_feature (368)..(368): n is a, c, g, or t/u
  misc_feature (402)..(402): n is a, c, g, or t/u
  misc_feature (405)..(405): n is a, c, g, or t/u
  misc_feature (414)..(414): n is a, c, g, or t/u
  misc_feature (429)..(429): n is a, c, g, or t/u
  misc_feature (439)..(439): n is a, c, g, or t/u
  misc_feature (447)..(447): n is a, c, g, or t/u
  misc_feature (457)..(459): n is a, c, g, or t/u
  misc_feature (464)..(464): n is a, c, g, or t/u
  misc_feature (480)..(481): n is a, c, g, or t/u
  misc_feature (495)..(495): n is a, c, g, or t/u
  misc_feature (501)..(501): n is a, c, g, or t/u
  misc_feature (510)..(510): n is a, c, g, or t/u
  misc_feature (512)..(513): n is a, c, g, or t/u
  misc_feature (519)..(519): n is a, c, g, or t/u
  misc_feature (521)..(522): n is a, c, g, or t/u
  misc_feature (524)..(524): n is a, c, g, or t/u
  misc_feature (530)..(530): n is a, c, g, or t/u
  misc_feature (532)..(532): n is a, c, g, or t/u
  misc_feature (535)..(535): n is a, c, g, or t/u
  misc_feature (540)..(540): n is a, c, g, or t/u
  misc_feature (545)..(545): n is a, c, g, or t/u
  misc_feature (549)..(549): n is a, c, g, or t/u
  misc_feature (557)..(558): n is a, c, g, or t/u
  misc_feature (563)..(564): n is a, c, g, or t/u
  misc_feature (575)..(575): n is a, c, g, or t/u
  misc_feature (583)..(583): n is a, c, g, or t/u
  misc_feature (586)..(587): n is a, c, g, or t/u
  misc_feature (590)..(590): n is a, c, g, or t/u
  misc_feature (597)..(597): n is a, c, g, or t/u
  misc_feature (607)..(607): n is a, c, g, or t/u
  misc_feature (610)..(611): n is a, c, g, or t/u
  misc_feature (614)..(614): n is a, c, g, or t/u
  misc_feature (618)..(618): n is a, c, g, or t/u
  misc_feature (620)..(621): n is a, c, g, or t/u
  misc_feature (627)..(627): n is a, c, g, or t/u
  misc_feature (632)..(632): n is a, c, g, or t/u
  misc_feature (634)..(634): n is a, c, g, or t/u
  misc_feature (654)..(654): n is a, c, g, or t/u
  misc_feature (657)..(657): n is a, c, g, or t/u
  misc_feature (678)..(678): n is a, c, g, or t/u
  misc_feature (692)..(692): n is a, c, g, or t/u
  misc_feature (701)..(701): n is a, c, g, or t/u
  misc_feature (703)..(703): n is a, c, g, or t/u
  misc_feature (705)..(705): n is a, c, g, or t/u
  misc_feature (708)..(708): n is a, c, g, or t/u
  misc_feature (728)..(728): n is a, c, g, or t/u
  misc_feature (735)..(735): n is a, c, g, or t/u
  misc_feature (759)..(759): n is a, c, g, or t/u
  misc_feature (762)..(762): n is a, c, g, or t/u
  misc_feature (769)..(769): n is a, c, g, or t/u
  misc_feature (771)..(771): n is a, c, g, or t/u
  misc_feature (780)..(781): n is a, c, g, or t/u
  misc_feature (786)..(786): n is a, c, g, or t/u
  misc_feature (788)..(788): n is a, c, g, or t/u
  misc_feature (792)..(792): n is a, c, g, or t/u
  misc_feature (800)..(800): n is a, c, g, or t/u
  misc_feature (802)..(802): n is a, c, g, or t/u
  misc_feature (807)..(808): n is a, c, g, or t/u
  misc_feature (810)..(810): n is a, c, g, or t/u
  misc_feature (812)..(812): n is a, c, g, or t/u
  misc_feature (815)..(815): n is a, c, g, or t/u
  misc_feature (834)..(834): n is a, c, g, or t/u
  misc_feature (839)..(839): n is a, c, g, or t/u
  misc_feature (845)..(845): n is a, c, g, or t/u
  misc_feature (855)..(855): n is a, c, g, or t/u
  misc_feature (864)..(864): n is a, c, g, or t/u
  misc_feature (866)..(866): n is a, c, g, or t/u
  misc_feature (872)..(873): n is a, c, g, or t/u
  misc_feature (876)..(876): n is a, c, g, or t/u
  misc_feature (883)..(883): n is a, c, g, or t/u
  misc_feature (887)..(888): n is a, c, g, or t/u
  misc_feature (890)..(890): n is a, c, g, or t/u
  misc_feature (895)..(895): n is a, c, g, or t/u
  misc_feature (899)..(900): n is a, c, g, or t/u
  misc_feature (902)..(902): n is a, c, g, or t/u
  misc_feature (912)..(912): n is a, c, g, or t/u
  misc_feature (918)..(918): n is a, c, g, or t/u
  misc_feature (932)..(933): n is a, c, g, or t/u
  misc_feature (938)..(938): n is a, c, g, or t/u
  misc_feature (944)..(946): n is a, c, g, or t/u
  misc_feature (950)..(950): n is a, c, g, or t/u
  misc_feature (959)..(961): n is a, c, g, or t/u
  misc_feature (969)..(969): n is a, c, g, or t/u
  misc_feature (975)..(975): n is a, c, g, or t/u
  misc_feature (977)..(977): n is a, c, g, or t/u
  misc_feature (982)..(982): n is a, c, g, or t/u
  misc_feature (986)..(986): n is a, c, g, or t/u
  misc_feature (990)..(990): n is a, c, g, or t/u
  misc_feature (993)..(993): n is a, c, g, or t/u
  misc_feature (999)..(999): n is a, c, g, or t/u
  misc_feature (1005)..(1005): n is a, c, g, or t/u
  misc_feature (1019)..(1019): n is a, c, g, or t/u
  misc_feature (1021)..(1021): n is a, c, g, or t/u
  misc_feature (1031)..(1031): n is a, c, g, or t/u
  misc_feature (1033)..(1033): n is a, c, g, or t/u
  misc_feature (1040)..(1040): n is a, c, g, or t/u
  misc_feature (1043)..(1043): n is a, c, g, or t/u
  misc_feature (1047)..(1047): n is a, c, g, or t/u
  misc_feature (1049)..(1049): n is a, c, g, or t/u
  misc_feature (1055)..(1056): n is a, c, g, or t/u
  misc_feature (1063)..(1063): n is a, c, g, or t/u
  misc_feature (1072)..(1072): n is a, c, g, or t/u
  misc_feature (1078)..(1078): n is a, c, g, or t/u
  misc_feature (1080)..(1080): n is a, c, g, or t/u
  misc_feature (1083)..(1084): n is a, c, g, or t/u
  misc_feature (1088)..(1088): n is a, c, g, or t/u
  misc_feature (1096)..(1096): n is a, c, g, or t/u
  misc_feature (1106)..(1106): n is a, c, g, or t/u
  misc_feature (1108)..(1108): n is a, c, g, or t/u
  misc_feature (1111)..(1111): n is a, c, g, or t/u
  misc_feature (1116)..(1116): n is a, c, g, or t/u
  misc_feature (1120)..(1120): n is a, c, g, or t/u
  misc_feature (1122)..(1123): n is a, c, g, or t/u
  misc_feature (1127)..(1127): n is a, c, g, or t/u
  misc_feature (1141)..(1142): n is a, c, g, or t/u
  misc_feature (1161)..(1161): n is a, c, g, or t/u
  misc_feature (1166)..(1166): n is a, c, g, or t/u
  misc_feature (1168)..(1168): n is a, c, g, or t/u
  misc_feature (1172)..(1172): n is a, c, g, or t/u
  misc_feature (1190)..(1190): n is a, c, g, or t/u
  misc_feature (1194)..(1194): n is a, c, g, or t/u
  misc_feature (1200)..(1200): n is a, c, g, or t/u
  misc_feature (1204)..(1206): n is a, c, g, or t/u
  misc_feature (1212)..(1213): n is a, c, g, or t/u
  misc_feature (1222)..(1222): n is a, c, g, or t/u
  misc_feature (1235)..(1235): n is a, c, g, or t/u
aacgctgganctcgcgcgcctgcaggtcgacactagtggatccaaagaattcggnncgaggatgaacgannttntggcagagtcngctaangaactccctcaagtttcatttgtgaagccggaagctgaaggtgttcctgnagtatntgaaaaatatgagattagctctgtnnccactttnntgttttnnnagaattctnacaaaatccaccgattgtatggcgctgcatgcccnaaagnnnnccctaantgacnttngnctgtgcatctctcggttccttcntacccagcgctaatgaacatcttanagaagatctcaaccttcgcttgaagaanttgactcatgctgccccctgcatgctgctatnaaaggaactcctcagaaccacgctgtggtttcancangcagatggnggaaattcttcacanacataatatncagtttancagtttttgnnntcatntcagatgaaaaggttnnacagggacttaaancctatnccagctggncnncctaancnnanctctangnttntgganagctnatangaggactnnctttnnttaaggagcgngaagcatnttnnagnaactttnattccaattnggnnccnaaancnncccaanttttntngaaaagctcaaacgtgcttnacnaataaaagctttccttgtggnagctttttttttgnaaacgggancnanacngggaaccccaaaattgtggnattttcnttaaaaccaaattttcgtggaaanatnctaaaantnggtcctggnnggttngnaacnttgaaaanantttcnnantnttnggggagggaaggaaataangttcngaccanggggttaaanaagcttcantnaaaatnnggnccaaaantacnncntcaangttnntnttttttaaangggggnaactttggtggggnnaggantcgggnnnttgngggaaaggnnnccttaaanaaaaangnggganatangccnccnttttcncggganggggaaaaattatnanattttttaancntcggggngcncccnanattttnnggggggngggcttttntacccngnccnnttanaaagaaanggccacctantnttnggtcnattncnngccntaaacctttttgcnngtccaaaaaaaaaaaattntggcncntatntctttcgggaaaaaaagngacncccagnggtnnncccccnnctttccccnctggggtggcatn

SEQ ID NO: 80 - DNA, 733 bp, Homo sapiens
  misc_feature (206)..(206): n is a, c, g, or t/u
  misc_feature (544)..(544): n is a, c, g, or t/u
  misc_feature (594)..(594): n is a, c, g, or t/u
  misc_feature (609)..(609): n is a, c, g, or t/u
  misc_feature (629)..(629): n is a, c, g, or t/u
  misc_feature (634)..(634): n is a, c, g, or t/u
  misc_feature (639)..(639): n is a, c, g, or t/u
  misc_feature (650)..(650): n is a, c, g, or t/u
  misc_feature (670)..(670): n is a, c, g, or t/u
  misc_feature (686)..(686): n is a, c, g, or t/u
accagttaattttttattttttgtagatatgaggtttcgccatgttgctcaggctggtctcaagctccggagctcaagcaacccgcctgcctccgcctcccaaagtgctgggatcacaagcacgagccattgtgcccagcctggcacttaatttgtgaaagccacaccatttctaacaggaacataaaaataccaggtcatttcanaagccccagacttgggcaactccactcactaacttgcagcgtgctacctcaaagccagtgtggcacgaggcttcaagcacagcactggggctgcgctgacagatcctggttcaaatcccagctcccagccctagaaccttacagtgacctaagtgcaccaagactccctcaacgtgttctgctgcagccagtgagtcagtgcacgtgcccggcccatgagctaactgaactcatggcttctgaatctgaatgtctctaaatatcagacaaagctgtatgaaaaaagcccccaagactctgaaaccagatgggatgccagttataaaacttgtcttttnaaggtacccatcctggtgaatgaggcatcaggaaacttctgcagctttgngtctgattcaaaaangggggataccttttccttanccatnacaanggggcacaagnccgacacttctggtaaattncaacacttttggggangcttgaggcaaggaaaaccttattttttttccaagaaaataaaaaaa

SEQ ID NO: 81 - DNA, 1058 bp, Homo sapiens
  misc_feature (3)..(3): n is a, c, g, or t/u
  misc_feature (605)..(605): n is a, c, g, or t/u
  misc_feature (677)..(677): n is a, c, g, or t/u
  misc_feature (745)..(745): n is a, c, g, or t/u
  misc_feature (830)..(830): n is a, c, g, or t/u
  misc_feature (843)..(843): n is a, c, g, or t/u
  misc_feature (853)..(853): n is a, c, g, or t/u
  misc_feature (920)..(920): n is a, c, g, or t/u
  misc_feature (924)..(924): n is a, c, g, or t/u
  misc_feature (926)..(926): n is a, c, g, or t/u
  misc_feature (928)..(928): n is a, c, g, or t/u
  misc_feature (930)..(930): n is a, c, g, or t/u
  misc_feature (937)..(937): n is a, c, g, or t/u
  misc_feature (980)..(980): n is a, c, g, or t/u
  misc_feature (987)..(987): n is a, c, g, or t/u
  misc_feature (998)..(999): n is a, c, g, or t/u
  misc_feature (1001)..(1001): n is a, c, g, or t/u
  misc_feature (1015)..(1015): n is a, c, g, or t/u
  misc_feature (1034)..(1034): n is a, c, g, or t/u
  misc_feature (1038)..(1038): n is a, c, g, or t/u
  misc_feature (1040)..(1040): n is a, c, g, or t/u
ggngctcgcgcgcctgcaggtcgacactagtggatccaaagttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggaacgccgccattctctggagaacaaggtaaagagactagagaccatggagcgtagagaaaacagactgaaggatgacatccagacaaaatcccaacagatccagcagatggctgataaaattctggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaanggcaaaattcttcagcgaacagaaggcgatgatcaatgctatggattccaagatcagatccctggaacagangattgtggaactgtctgaagcccataaacttgcacaaatagcagtctttttcccaaaggacattgaanggcccaagaagagatgatttctgaactcaggccacaagaaatttacctggaaacacagctgggaaagtttggaggcccaaaaccnaaactggaggacnactggggaanataacccccaagaacccagtgacaaaaatcggttgttggactggagacaaaattgggggaggcagtnttancncnanggggccnaacttgggcttaacgccagttaaaaaaatttaagttttcttgnggaaccngattacaattnnanccttcaggtttacnggggggcctggaaaacccntttncnggcgaaaaaaaacttgga

SEQ ID NO: 82 - DNA, 713 bp, Homo sapiens
  misc_feature (77)..(77): n is a, c, g, or t/u
  misc_feature (117)..(117): n is a, c, g, or t/u
  misc_feature (184)..(184): n is a, c, g, or t/u
  misc_feature (194)..(194): n is a, c, g, or t/u
  misc_feature (224)..(224): n is a, c, g, or t/u
  misc_feature (363)..(363): n is a, c, g, or t/u
  misc_feature (370)..(370): n is a, c, g, or t/u
  misc_feature (372)..(372): n is a, c, g, or t/u
  misc_feature (446)..(446): n is a, c, g, or t/u
  misc_feature (465)..(465): n is a, c, g, or t/u
  misc_feature (514)..(514): n is a, c, g, or t/u
  misc_feature (517)..(517): n is a, c, g, or t/u
  misc_feature (536)..(536): n is a, c, g, or t/u
  misc_feature (573)..(573): n is a, c, g, or t/u
  misc_feature (611)..(611): n is a, c, g, or t/u
  misc_feature (615)..(615): n is a, c, g, or t/u
  misc_feature (629)..(629): n is a, c, g, or t/u
  misc_feature (631)..(631): n is a, c, g, or t/u
  misc_feature (647)..(647): n is a, c, g, or t/u
  misc_feature (661)..(661): n is a, c, g, or t/u
  misc_feature (664)..(664): n is a, c, g, or t/u
  misc_feature (667)..(667): n is a, c, g, or t/u
  misc_feature (675)..(675): n is a, c, g, or t/u
  misc_feature (686)..(686): n is a, c, g, or t/u
  misc_feature (692)..(693): n is a, c, g, or t/u
  misc_feature (701)..(701): n is a, c, g, or t/u
acgaatataaagtttcttgtaaatatgtacagtcttttgagctagttctatatagcagaaagcagttcacagatganacacacaatatacattttcagggctcaagaagcccatttntcatggagatcctaaatgaaatgccaagactgaaagacccattttcagtgacctttccaaatactgnggaccaaganacaaaacttcagcaaacattcaatcaaatntgccctggggacgggaggggagggagtaccaccccacagactccaagcaacacataaaacgccacagcaggacatttgccaaaggagctaccacatggaggtttgtaggcgtttcaaacaagaaagcacttaggttaanacaccancnggaaggagctgggatgcaggccaagttgcaatctggaaagggatctgaactgtggacacagttgaaaacacggncatgttcacctgctgcggnggaaacgggtctcctttgagcctacctaagaggggcctgggttgttgangcnggcctaaaaagtcgtgganggacccaaagcaacagatgccttgggggagaataaangcagaaataagggcgcgagttacttgccaactgcaaancctntaggtgggtctgtncnattgcccagaatttcntacttttataaganggnccncaaacccnatggggagccnccttgnnctaaggcnttcccacccttg

SEQ ID NO: 83 - DNA, 771 bp, Homo sapiens
  misc_feature (533)..(533): n is a, c, g, or t/u
  misc_feature (595)..(595): n is a, c, g, or t/u
  misc_feature (633)..(633): n is a, c, g, or t/u
  misc_feature (656)..(656): n is a, c, g, or t/u
  misc_feature (679)..(679): n is a, c, g, or t/u
  misc_feature (705)..(705): n is a, c, g, or t/u
  misc_feature (715)..(715): n is a, c, g, or t/u
  misc_feature (766)..(766): n is a, c, g, or t/u
actttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcangaagctctgaaattaatccacccaacagagaacatcaccttccatgcagtctcttctgtggngaacaactcgcgaaacaacacttctgagtgtctggctnctgtcgacttggtggtcaaaaangagctcaaggcaagtggcaatancccaaaagatgttgcaatgggttggncccaaagtcnccccaaaaaggaagactcaaaaacccttcaaaaggaaaaagtcagatgttncccaa

SEQ ID NO: 84 - DNA, 961 bp, Homo sapiens
  misc_feature (684)..(684): n is a, c, g, or t/u
  misc_feature (689)..(689): n is a, c, g, or t/u
  misc_feature (729)..(729): n is a, c, g, or t/u
  misc_feature (738)..(738): n is a, c, g, or t/u
  misc_feature (770)..(770): n is a, c, g, or t/u
  misc_feature (777)..(777): n is a, c, g, or t/u
  misc_feature (806)..(806): n is a, c, g, or t/u
  misc_feature (819)..(819): n is a, c, g, or t/u
  misc_feature (826)..(826): n is a, c, g, or t/u
  misc_feature (833)..(833): n is a, c, g, or t/u
  misc_feature (838)..(838): n is a, c, g, or t/u
  misc_feature (842)..(842): n is a, c, g, or t/u
  misc_feature (850)..(850): n is a, c, g, or t/u
  misc_feature (854)..(854): n is a, c, g, or t/u
  misc_feature (859)..(859): n is a, c, g, or t/u
  misc_feature (870)..(870): n is a, c, g, or t/u
  misc_feature (876)..(876): n is a, c, g, or t/u
  misc_feature (885)..(885): n is a, c, g, or t/u
  misc_feature (890)..(890): n is a, c, g, or t/u
  misc_feature (901)..(901): n is a, c, g, or t/u
  misc_feature (918)..(918): n is a, c, g, or t/u
  misc_feature (958)..(958): n is a, c, g, or t/u
ctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcaagtttctaaatggcttgactttggtgaagtctcaactcaggaagctctgaaattaatccacccacagagaacatcaccttccatgcagtctcttctgtggtgaacaactcgcgaaacaacacttcctgagtgtctggctcctgtcgacttgggnggtcnaaaaaagagcttcagggcaagtggcagtaacccaaaaganttttgccantgggttgggccccaaaagttcaccccaaaaanggaaganctcaaaaaacaccctcaaaaagggaaaanatccagattgttnccccagngggtccnagtcngttnctggcaanaaanaaatnccccttccccncccaanaaaaaggcncctgncaggacttccntaaaaccaatgggcttnaaaccgggaaaaaaggaaggagggaacctttggggccaancgt

SEQ ID NO: 85 - DNA, 478 bp, Homo sapiens
accaaatacaatttattcaggaaaaaaataaattttaagaacttatttttattttattttagaacttaaaaataaatttttaagaactaaaaaagtgaaagagcccagtggctgagcagaaaacagcttactacaaggagtaccagatcagggcagagacttcccagctgggtaaggcatgctttgagggaagactccaccagccctgccaggaaagggcagcaggcgcagtgcccctatggggcccacatggctggtaacagcagcaggacacctcttccaaagctgtccaccagccccactaggggctcctactcatggcaaaaaagactacatgagcccacaactgtcaactaacacagtgccacctcctcccaaagcaaacacatatacatacaatgttaagaacctattatcagaacagcagtgcagcagaccctggccttggtctctgaaagtcctgtgtcactggctgtaa

SEQ ID NO: 86 - DNA, 830 bp, Homo sapiens
  misc_feature (616)..(616): n is a, c, g, or t/u
  misc_feature (618)..(618): n is a, c, g, or t/u
  misc_feature (676)..(676): n is a, c, g, or t/u
  misc_feature (679)..(679): n is a, c, g, or t/u
  misc_feature (691)..(691): n is a, c, g, or t/u
  misc_feature (727)..(727): n is a, c, g, or t/u
  misc_feature (741)..(741): n is a, c, g, or t/u
  misc_feature (757)..(757): n is a, c, g, or t/u
  misc_feature (759)..(759): n is a, c, g, or t/u
  misc_feature (762)..(762): n is a, c, g, or t/u
  misc_feature (789)..(789): n is a, c, g, or t/u
  misc_feature (827)..(827): n is a, c, g, or t/u
gcagtttcagtatcctgtatcacgtatttgaggggaatattcccagaatgcgcttatggaacaagatatctagatgatctttgtgtcaaaatactgagagaagataaaaattgcccaggatctacacagttagtgaaatggatgctaggatgttatgatgctttacagaaaaaatatctaaggatggttgttctagctgtatacacaaacccagaagatcctcagacaatttcagaatgttaccaattcaaattcaaatacaccaataatggaccactcatggacttcataagtaaaaaccaaagcaacgaatctagcatgttgtctactgacaccaagaaagcaagcattctcctcattcgcaagatttatatcctaatgcaaaatctggggcctttacctaatgatgtttgtttgaccatgaaacttttttactatgatgaagttacacccccagattaccagcctcccggttttaaggatggtgattgtgaaggagttatatttgaaggggaacctatgtatttaaatgtgggagaagtctcaacaccttttcacatcttcaaagtaaaagtgaccactgagagagaacgaatggaaaatattgactcaactntnctatcaccaaaacaaataaaaacaccatttcaaaaaatcctgagggacaaagatgttnaanatgaacaggacntttatataagtggatgattttggacattgaaaactnaaatggaagaacanggaaaaaaaccctgcntnttntgacttgaaaaaccaagtttagtttgnggaggaagatgaaattatgagggctaaagaaagtccanaac

SEQ ID NO: 87 - DNA, 747 bp, Homo sapiens
  misc_feature (549)..(549): n is a, c, g, or t/u
  misc_feature (596)..(596): n is a, c, g, or t/u
  misc_feature (661)..(661): n is a, c, g, or t/u
  misc_feature (672)..(672): n is a, c, g, or t/u
  misc_feature (691)..(691): n is a, c, g, or t/u
  misc_feature (729)..(729): n is a, c, g, or t/u
  misc_feature (736)..(736): n is a, c, g, or t/u
actgaacaatattttatttatgctgcaaaaaatgccatactttaaaaatcagtctttttgtcctgtaaaaaaaagcatagtaaaggtaaagcaccaattcttaaattgtacattatatattaaaatgttaatacattatgtcaaaatattgaagaacattgttttaataacagcacaatgacaaaagagccagttaaatggtataattttaacataagtaaaaagtgaatccataccaaattttaataccaaagtaaacattactgtttagaaaaatggcattagagggccttaacagttagtatatatttaaaggaaatattaagtaggtaatgaacaaaatcaattttgaaattttacttattaccgaatcaattatgacatttgtcttttgcttttattcaaaagttctattggatttatctcaagattaaggaccacaatatgacagtcagccaaaaacttagttttagtgtacaaactgctttaaactacatatacatcttcagagttagggaaatataatatagggccttcagtttaaatggngagaagaactctgcagcctgcagaacaaaaataattttatatatgtnctttgggtcactaaactttctcctttttggcactgactcttgactagaaaaatcaaagggatggnggactattctnccaaaatcatgttgacttntcttccgatttcttttggaagatttactgggtggattncatttgncatttattctg

SEQ ID NO: 88 - DNA, 1003 bp, Homo sapiens
  misc_feature (8)..(8): n is a, c, g, or t/u
  misc_feature (19)..(19): n is a, c, g, or t/u
  misc_feature (849)..(849): n is a, c, g, or t/u
  misc_feature (856)..(856): n is a, c, g, or t/u
  misc_feature (862)..(862): n is a, c, g, or t/u
  misc_feature (895)..(895): n is a, c, g, or t/u
  misc_feature (897)..(897): n is a, c, g, or t/u
  misc_feature (935)..(935): n is a, c, g, or t/u
  misc_feature (939)..(939): n is a, c, g, or t/u
  misc_feature (950)..(950): n is a, c, g, or t/u
  misc_feature (969)..(969): n is a, c, g, or t/u
  misc_feature (978)..(978): n is a, c, g, or t/u
  misc_feature (999)..(999): n is a, c, g, or t/u
aaactctnctcgcgcgccngcaggtcgacactagtggatccaaagcaatgatgctacctgttctgacccatcatatccgctaccaccaatgcctaatgcatttggacaagttgataggatatactttccaagatcgttgtctgttgcagctggccatgactcatccaagtcatcatttaaattttggaatgaatcctgatcatgccaggaattcattatctaactgtggaattcggcagcccaaatacggagacagaaaagttcatcacatgcacatgcggaagaaagggattaacaccttgataaatatcatgtcacgccttggccaagatgacccaactccctcgaggattaaccacaatgaacggttggaattcctgggtgatgctgttgttgaatttctgaccagcgtccatttgtactatttgtttcctagtctggaagaaggaggattagcaacctatcggactgccattgttcagaatcagcaccttgccatgctagcaaagaaacttgaactggatcgatttatgctgtatgctcacgggcctgacctttgtagagaatcggaccttcgacatgcaatggccaattgttttgaagcgttaataggagctgtttacttggagggaagcctggaggaagccaagcagttatttggacgcttgctctttaatgatccggacctgcgcgaagtctggctcaattatcctcttcacccactccaactacaagagccaaatactgatcgacaacttattggaaactttttccagttctacaaaaaacttactgagtttgaaagaaaccaattgggagtaaattttttactcattggttccgactttntggcaangggccnttcacatttgagaaactggggggatttaacccntntgaccccttaggccccaatcagaagaaatgggaaattnctanggggacttccntaatggcaacctggggagncccccagangaccttattcatttcattttnccca

SEQ ID NO: 89 - DNA, 763 bp, Homo sapiens
  misc_feature (513)..(513): n is a, c, g, or t/u
  misc_feature (552)..(552): n is a, c, g, or t/u
  misc_feature (569)..(569): n is a, c, g, or t/u
  misc_feature (599)..(599): n is a, c, g, or t/u
  misc_feature (602)..(602): n is a, c, g, or t/u
  misc_feature (606)..(606): n is a, c, g, or t/u
  misc_feature (655)..(655): n is a, c, g, or t/u
  misc_feature (702)..(702): n is a, c, g, or t/u
  misc_feature (709)..(709): n is a, c, g, or t/u
  misc_feature (714)..(714): n is a, c, g, or t/u
  misc_feature (721)..(721): n is a, c, g, or t/u
  misc_feature (736)..(736): n is a, c, g, or t/u
  misc_feature (753)..(753): n is a, c, g, or t/u
gcgatttgactctgtattttatttcaatgagcacacttcgttcattgtctgcaggaaaactaggctaggtctcaatagacaacagtcacagttactgagcaagtaaatactccacacttgcatgccctcctttatttcttgatgtcttcagtctcatctggctctctctcttgatgctctctttcccacctcatttcttttaactcttgtctgtacttccgttcgatgaaccgcttctgatgggccatctggggaaaattatatttttcaagcgcatccattgctgctcccatttccgcttgctgaatacttggtcctttcccacagcctattctttctcccttgaaataaacagccacagtgtaggttcgggcatgggatgggcccactgtctgcagagtcttgtacaaaggaatgtctggctcttttccttctgcctaagggcaagcaacactgctgaagctgggatttggggcattccaatcctgattcaaaatgaactcttttaatcgnggaaagaaacagacattcatgaaaagtatgaacatattncaaatccttatcaatgnacagcgctgcaataaatgattccaaaaggnccnccanggcttggggcgaaacccccaaggccttttggcttggcgtgggtattggnggactcctggatgcccaagttcttccgtaccttgggcctgggttttntattcancaaanagcttcnaacaaagttaagggnccttatgaagactgggnaaagaaagaa

SEQ ID NO: 90 - DNA, 586 bp, Homo sapiens
  misc_feature (2)..(2): n is a, c, g, or t/u
  misc_feature (16)..(16): n is a, c, g, or t/u
  misc_feature (19)..(19): n is a, c, g, or t/u
  misc_feature (25)..(25): n is a, c, g, or t/u
  misc_feature (488)..(488): n is a, c, g, or t/u
  misc_feature (559)..(559): n is a, c, g, or t/u
  misc_feature (576)..(576): n is a, c, g, or t/u
gncctataatgagtcntantacaangtcgacactagtggatccaaagctctgcttagtatatgtttacatgcctaatggttcattgctagacagactctcttgcttggatggtactccaccactttcttggcacatgagatgcaagattgctcagggtgcagctaatggcatcaattttctacatgaaaatcatcatattcatagagatattaaaagtgcaaatatcttactggatgaagcttttactgctaaaatatctgactttggccttgcacgggcttctgagaagtttgcccagacagtcatgactagcagaattgtgggaacaacagcttatatggcaccagaagctttgcgtggagaaataacacccaaatctgatatttacagctttggtgtggttttactagaaataataactggacttccagctgtggatgaacaccgggaacctcagttattgctagatattaaaagaagaaattgnagatgaagaaaagacaattgaagattatattgataaaaagatgaatgatgctgattccacttcagttgaanctatgtacctctgttgntagtcaatgt

SEQ ID NO: 91 - DNA, 630 bp, Homo sapiens
  misc_feature (467)..(467): n is a, c, g, or t/u
  misc_feature (493)..(493): n is a, c, g, or t/u
  misc_feature (547)..(547): n is a, c, g, or t/u
  misc_feature (559)..(559): n is a, c, g, or t/u
  misc_feature (575)..(575): n is a, c, g, or t/u
  misc_feature (578)..(578): n is a, c, g, or t/u
  misc_feature (595)..(595): n is a, c, g, or t/u
  misc_feature (602)..(602): n is a, c, g, or t/u
  misc_feature (615)..(615): n is a, c, g, or t/u
aatgtgacccatttatttatttatttatttatgatggagtctcactctgtcacccaggctggagtgcagtggcacgatctcagctcactgcaacctctacctccctggttccagctagtctcctgcctcagcctcccaagtagctgggactacaggtgtccaccaccacgctcgtctaatttttgtatttttagtaaagacggggtttcaccatgttggccaggccggtcttgaactcttgacctcaggtgatctgcctgcctcggcctcccaaagtgctgggatttacaggtatgagccaccacatccagccaatgtgacccattatctcacagttctatatattagaagtccagcacagaacagatagattctcatactgaggatcatgcaaagctgaaatccaggtgtcagcccaggctgtggttatcatctgaagcttggagtactcttctaagctgactcanatttttggcagaattcagttccttgnggttgcaactgaaggtcccaatttttttttcctgcttgctgacaactggaaggnaggtctcatctnctaaaggcccctttanggntttagccaaatgtgggnccttttnacatacttttttnaaggcttaacaaagg

SEQ ID NO: 92 - DNA, 469 bp, Homo sapiens; identical to SEQ ID NO: 16
  misc_feature (13)..(13): n is a, c, g, or t/u
  misc_feature (111)..(111): n is a, c, g, or t/u
  misc_feature (120)..(120): n is a, c, g, or t/u
  misc_feature (164)..(164): n is a, c, g, or t/u
  misc_feature (194)..(194): n is a, c, g, or t/u
  misc_feature (245)..(245): n is a, c, g, or t/u
  misc_feature (344)..(344): n is a, c, g, or t/u
  misc_feature (372)..(372): n is a, c, g, or t/u
  misc_feature (436)..(436): n is a, c, g, or t/u

SEQ ID NO: 93 - DNA, 712 bp, Homo sapiens; identical to SEQ ID NO: 17
  misc_feature (578)..(578): n is a, c, g, or t/u
  misc_feature (591)..(591): n is a, c, g, or t/u
  misc_feature (620)..(620): n is a, c, g, or t/u
  misc_feature (645)..(645): n is a, c, g, or t/u
  misc_feature (662)..(662): n is a, c, g, or t/u
  misc_feature (679)..(679): n is a, c, g, or t/u

SEQ ID NO: 94 - DNA, 846 bp, Homo sapiens
  misc_feature (713)..(713): n is a, c, g, or t/u
  misc_feature (779)..(779): n is a, c, g, or t/u
  misc_feature (814)..(814): n is a, c, g, or t/u
gaaagaacaacgaaaagaaaatgaacctgaagcagaaaaaactcatttatttgcaaaacaggagaaagccttctatcctaaatcatttaaaagtaaaaaacaaaagccatctagggtcttatattcaagtactgaaagttctgatgaagaagctcttcagaataaaaagatttctacttcatgttccgtcatccctgaaacatcaaattctgatatgcaaaccaaaaaggaatatgtagtttcaggtgaacacaaacagaaaggcaaagttaaaagaaaattgaaaaatcagaataaaaataaagagaaccaagagctaaagcaagaaaaggaaggaaaagaaaatacaagaataacaaacttgacagtaaatactggactagattgttcagaaaagaccagagaggaggggaactttaggaaatcttttagcccaaaagatgatacttcattacatttatttcatatttccactggtaaatctcccaaacattcttgtggattaaagtgaaaaacagtcaacaccactaaaacaagaacatactaaaacatgtttatcaccaggaagttctgaaatgtcattacagcctgatcttgttcggtatgataatacagaatctgaattcttgcccagaaagttcaagtgtaaaatctttgtaagccttaagggaaaaaagcaaacatcagaaagatttcccctttagaatttgggngaaaaatcaaaatgccaaaaattaaagggatgaaggatcattagtcccacatttggaaaaattcanaattggcacacttgaaaaaaatgggataaaggaanggtaaaaccttttaaaaaaacataaatttgga

SEQ ID NO: 95 - DNA, 505 bp, Homo sapiens
  misc_feature (21)..(21): n is a, c, g, or t/u
  misc_feature (51)..(51): n is a, c, g, or t/u
  misc_feature (60)..(60): n is a, c, g, or t/u
  misc_feature (79)..(79): n is a, c, g, or t/u
  misc_feature (102)..(102): n is a, c, g, or t/u
  misc_feature (158)..(158): n is a, c, g, or t/u
  misc_feature (177)..(177): n is a, c, g, or t/u
  misc_feature (200)..(200): n is a, c, g, or t/u
  misc_feature (208)..(208): n is a, c, g, or t/u
  misc_feature (219)..(219): n is a, c, g, or t/u
  misc_feature (226)..(226): n is a, c, g, or t/u
  misc_feature (241)..(241): n is a, c, g, or t/u
  misc_feature (249)..(249): n is a, c, g, or t/u
  misc_feature (252)..(252): n is a, c, g, or t/u
  misc_feature (258)..(258): n is a, c, g, or t/u
  misc_feature (308)..(308): n is a, c, g, or t/u
  misc_feature (319)..(319): n is a, c, g, or t/u
  misc_feature (330)..(330): n is a, c, g, or t/u
  misc_feature (337)..(337): n is a, c, g, or t/u
  misc_feature (352)..(352): n is a, c, g, or t/u
  misc_feature (356)..(356): n is a, c, g, or t/u
  misc_feature (368)..(368): n is a, c, g, or t/u
  misc_feature (376)..(376): n is a, c, g, or t/u
  misc_feature (378)..(378): n is a, c, g, or t/u
  misc_feature (406)..(406): n is a, c, g, or t/u
  misc_feature (411)..(411): n is a, c, g, or t/u
  misc_feature (425)..(425): n is a, c, g, or t/u
  misc_feature (471)..(472): n is a, c, g, or t/u
  misc_feature (496)..(496): n is a, c, g, or t/u
atgcttttctttttccctctntttatgcttcaatttatgtttttttaatgntttaccttntttatccatttttttcagngggcaatctgaattttcaaatgntggactatgatcttcatcctttattttggcatttgatttttcaccaaattctaagnggaaatctttctgatgttngcttttttccttatgcttacaanattttacncttgaactttntggcaanaattcaaattctgtnttatcatnccnaacaanatcaggctgtaatgacatttcaaaacttcctggggataaacatgttttantatgttcttgntttaggggggntgactgnttttcacttaatccncaanaatgtttggganatttaccngnggaaatatgaaataaatgtaatgaagtntcatnttttgggctaaaanatttcctaaagttcccctcctctctggtcttttctgaacaatctannccagtatttactggcaaggttggnattcttgga

SEQ ID NO: 96 - DNA, 1647 bp, Homo sapiens
  misc_feature (1618)..(1618): n is a, c, g, or t/u
gtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgatgcaaatgaaaaaaaagttgaccagcctccagaagctaaaaagcccaaaataaaggtggtgaatgttgagctgcctattgaagccaacttggtctggcagttaggggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaangatatttagaaattttgtgtattatatgg

SEQ ID NO: 97 - DNA, 784 bp, Homo sapiens
  misc_feature (15)..(15): n is a, c, g, or t/u
  misc_feature (46)..(46): n is a, c, g, or t/u
  misc_feature (56)..(56): n is a, c, g, or t/u
  misc_feature (75)..(75): n is a, c, g, or t/u
  misc_feature (101)..(101): n is a, c, g, or t/u
  misc_feature (113)..(113): n is a, c, g, or t/u
  misc_feature (116)..(116): n is a, c, g, or t/u
  misc_feature (123)..(123): n is a, c, g, or t/u
  misc_feature (125)..(125): n is a, c, g, or t/u
  misc_feature (133)..(133): n is a, c, g, or t/u
  misc_feature (135)..(135): n is a, c, g, or t/u
  misc_feature (163)..(163): n is a, c, g, or t/u
  misc_feature (173)..(173): n is a, c, g, or t/u
  misc_feature (199)..(199): n is a, c, g, or t/u
  misc_feature (203)..(203): n is a, c, g, or t/u
  misc_feature (225)..(225): n is a, c, g, or t/u
  misc_feature (250)..(250): n is a, c, g, or t/u
  misc_feature (290)..(290): n is a, c, g, or t/u
  misc_feature (313)..(313): n is a, c, g, or t/u
  misc_feature (368)..(368): n is a, c, g, or t/u
  misc_feature (404)..(404): n is a, c, g, or t/u
  misc_feature (408)..(408): n is a, c, g, or t/u
  misc_feature (416)..(416): n is a, c, g, or t/u
  misc_feature (420)..(420): n is a, c, g, or t/u
  misc_feature (454)..(454): n is a, c, g, or t/u
  misc_feature (465)..(465): n is a, c, g, or t/u
  misc_feature (471)..(471): n is a, c, g, or t/u
  misc_feature (477)..(477): n is a, c, g, or t/u
  misc_feature (496)..(496): n is a, c, g, or t/u
  misc_feature (507)..(507): n is a, c, g, or t/u
  misc_feature (513)..(513): n is a, c, g, or t/u
  misc_feature (526)..(526): n is a, c, g, or t/u
  misc_feature (534)..(534): n is a, c, g, or t/u
  misc_feature (536)..(536): n is a, c, g, or t/u
  misc_feature (554)..(555): n is a, c, g, or t/u
  misc_feature (564)..(565): n is a, c, g, or t/u
  misc_feature (567)..(568): n is a, c, g, or t/u
  misc_feature (573)..(573): n is a, c, g, or t/u
  misc_feature (578)..(578): n is a, c, g, or t/u
  misc_feature (588)..(588): n is a, c, g, or t/u
  misc_feature (603)..(603): n is a, c, g, or t/u
  misc_feature (606)..(606): n is a, c, g, or t/u
  misc_feature (612)..(612): n is a, c, g, or t/u
  misc_feature (618)..(618): n is a, c, g, or t/u
  misc_feature (628)..(629): n is a, c, g, or t/u
  misc_feature (631)..(631): n is a, c, g, or t/u
  misc_feature (644)..(644): n is a, c, g, or t/u
  misc_feature (668)..(668): n is a, c, g, or t/u
  misc_feature (673)..(673): n is a, c, g, or t/u
  misc_feature (679)..(679): n is a, c, g, or t/u
  misc_feature (683)..(684): n is a, c, g, or t/u
  misc_feature (686)..(686): n is a, c, g, or t/u
  misc_feature (691)..(691): n is a, c, g, or t/u
  misc_feature (721)..(721): n is a, c, g, or t/u
  misc_feature (724)..(724): n is a, c, g, or t/u
  misc_feature (726)..(726): n is a, c, g, or t/u
  misc_feature (729)..(729): n is a, c, g, or t/u
  misc_feature (741)..(741): n is a, c, g, or t/u
  misc_feature (747)..(747): n is a, c, g, or t/u
  misc_feature (751)..(751): n is a, c, g, or t/u
  misc_feature (759)..(759): n is a, c, g, or t/u
  misc_feature (762)..(762): n is a, c, g, or t/u
  misc_feature (766)..(766): n is a, c, g, or t/u
  misc_feature (770)..(770): n is a, c, g, or t/u
gctatggcaaaaatnttttattaattgaaggaataggccaatttanggttatctancccaagtccatattaacanaatttttctcattagggtaacattcnccattctgatgnggnggttcancnccaaaatngnttttggcttctaaatcttcttccttttnatcaatattngggccatttggagttctttccagttngggngattcaatttttggtttcggtngggttacaacgggttcacatgtgtngccaattccttgatttttgttttaatttcctgagcccgtncaactggatcctgatcaaaactntttttagcctgagcattcatgacattattcatccattccatcacttcattaacanacttctccacttttttcatttcaaactcatcaatangggnggatttcncatncttatttctgaagtcagctgctatcttgggatantgctgcagccnctgccnagtctnaaaacatttttggccgttntaatgttcctnaaaccnaactttcactggngtgccaantntccttaatcctgccaccnngcaacgaanncnngcacnactcnggcctcctcntccggagacagcccnccntaagtnttgtgnggcgtcgtcnnanattttgaagaccngctcacatataaatttttcatatnggccncccagnttgnntntgacncataccaaattcccaactggttttaacccnttncnttnttttccaattantttggntatnatttaccnctngccnaatntttggaccccttat

SEQ ID NO: 98 - DNA, 593 bp, Homo sapiens
  misc_feature (4)..(4): n is a, c, g, or t/u
  misc_feature (63)..(63): n is a, c, g, or t/u
  misc_feature (67)..(67): n is a, c, g, or t/u
  misc_feature (137)..(137): n is a, c, g, or t/u
  misc_feature (149)..(149): n is a, c, g, or t/u
  misc_feature (155)..(155): n is a, c, g, or t/u
  misc_feature (217)..(217): n is a, c, g, or t/u
  misc_feature (238)..(238): n is a, c, g, or t/u
  misc_feature (407)..(407): n is a, c, g, or t/u
  misc_feature (425)..(425): n is a, c, g, or t/u
  misc_feature (476)..(476): n is a, c, g, or t/u
  misc_feature (516)..(516): n is a, c, g, or t/u
  misc_feature (520)..(520): n is a, c, g, or t/u
atgnagagtcacatactatggcaaaaatattttattaattgaaggaataggccaatttaaggntatntagtccaagtccatattaacagaatttttctcattagggtaacattcaccattctgatgtggaggttcancaccaaaattgnttttgncttctaaatcttcttcctttttatcaatatttgggccatttggagttctttccagtttgggngattcaatttttggtttcggntgtgttacaacgggttcacatgtgttgttcaattccttgatttttggtttaatttcctgagcacgtacaactggatcctgatcaagactctttttagcctgagcattcatgacattattcatccattccatcacttcattaacagacttctccacttttttcatttcanactcatcaatatgggtgnatttctcatccttatttctgaagcagctgctatcttggcataatgctgcancctctgcctagttcttcaaacatttttggccgttcttcancttnctgaaacccaactttaactgggagtgccaattttcattaaattctttcccacttggcaacatatgcttggtta

SEQ ID NO: 99 - DNA, 927 bp, Homo sapiens
  misc_feature (580)..(580): n is a, c, g, or t/u
  misc_feature (649)..(649): n is a, c, g, or t/u
  misc_feature (661)..(661): n is a, c, g, or t/u
  misc_feature (680)..(680): n is a, c, g, or t/u
  misc_feature (697)..(697): n is a, c, g, or t/u
  misc_feature (719)..(719): n is a, c, g, or t/u
  misc_feature (723)..(723): n is a, c, g, or t/u
  misc_feature (734)..(734): n is a, c, g, or t/u
  misc_feature (737)..(737): n is a, c, g, or t/u
  misc_feature (766)..(766): n is a, c, g, or t/u
  misc_feature (769)..(769): n is a, c, g, or t/u
  misc_feature (774)..(774): n is a, c, g, or t/u
  misc_feature (779)..(779): n is a, c, g, or t/u
  misc_feature (783)..(783): n is a, c, g, or t/u
  misc_feature (790)..(790): n is a, c, g, or t/u
  misc_feature (798)..(798): n is a, c, g, or t/u
  misc_feature (814)..(814): n is a, c, g, or t/u
  misc_feature (829)..(829): n is a, c, g, or t/u
  misc_feature (845)..(845): n is a, c, g, or t/u
  misc_feature (850)..(850): n is a, c, g, or t/u
  misc_feature (858)..(858): n is a, c, g, or t/u
  misc_feature (878)..(878): n is a, c, g, or t/u
  misc_feature (894)..(894): n is a, c, g, or t/u
  misc_feature (900)..(900): n is a, c, g, or t/u
gtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgatgcaaatgaaaaaaaagttgaccagcctccagaagctaaaaagcccaaaataaaggtggtgaatgttgagctgcctattgaagccaacttggtctggcagttaggggaaagaccttcttaacatgtatattgnagacaagagggtaagatgataatgcaagataaattggaaaaaagaaagggaatgatgctaaaaatgcanttgaaggaattntgtgttttgagttcaaganaccaagctggggtgggnccatattgaaaaaaattttatnttgnggagccaggantcnttcaaaattttttttggagacttcctcancanaaacntgaanactnggcttgntttgaaanaaagggagagggaccnagccttaaccaagcntttgttggccaagttnggaanaattaatngaaaattggcccccccgttnaaagttcggggtttanggaagntttaaaaacggcccaaaattttttgaa

SEQ ID NO: 100 - DNA, 838 bp, Homo sapiens
  misc_feature (46)..(46): n is a, c, g, or t/u
  misc_feature (116)..(116): n is a, c, g, or t/u
  misc_feature (221)..(221): n is a, c, g, or t/u
  misc_feature (408)..(408): n is a, c, g, or t/u
  misc_feature (497)..(497): n is a, c, g, or t/u
  misc_feature (499)..(499): n is a, c, g, or t/u
  misc_feature (526)..(526): n is a, c, g, or t/u
  misc_feature (528)..(528): n is a, c, g, or t/u
  misc_feature (554)..(554): n is a, c, g, or t/u
  misc_feature (567)..(568): n is a, c, g, or t/u
  misc_feature (618)..(618): n is a, c, g, or t/u
  misc_feature (644)..(644): n is a, c, g, or t/u
  misc_feature (681)..(681): n is a, c, g, or t/u
  misc_feature (689)..(689): n is a, c, g, or t/u
  misc_feature (702)..(702): n is a, c, g, or t/u
  misc_feature (711)..(711): n is a, c, g, or t/u
  misc_feature (716)..(716): n is a, c, g, or t/u
  misc_feature (727)..(727): n is a, c, g, or t/u
  misc_feature (733)..(733): n is a, c, g, or t/u
  misc_feature (738)..(738): n is a, c, g, or t/u
  misc_feature (752)..(752): n is a, c, g, or t/u
  misc_feature (764)..(764): n is a, c, g, or t/u
  misc_feature (767)..(767): n is a, c, g, or t/u
  misc_feature (776)..(776): n is a, c, g, or t/u
  misc_feature (780)..(780): n is a, c, g, or t/u
  misc_feature (784)..(784): n is a, c, g, or t/u
  misc_feature (802)..(802): n is a, c, g, or t/u
  misc_feature (811)..(811): n is a, c, g, or t/u
  misc_feature (824)..(824): n is a, c, g, or t/u
  misc_feature (826)..(826): n is a, c, g, or t/u
atggcaaaaatattttattaattgaaggaataggccaatttaaggntatctagtccaagtccatattaacagaatttttctcattagggtaacattcaccattctgatgtggaggntcagcaccaaaattgtttttgtcttctaaatcttcttcctttttatcaatatttgggccatttggagttctttccagtttgggtgattcaatttttggtttcggntgtgttacaacgggttcacatgtgttggtcaattccttgatttttgttttaatttcctgagcacgtacaactggatcctgatcaagactctttttagcctgagcattcatgacattattcatccattccatcacttcattaacagacttctccacttttttcatttcagactcatcaatatgggtgnatttctcatccttatttctgaagcagctgctatcttggcataatgctgcagcctctgcctagttcttcaaacatttttggccggtcttnancttcctgaaaccgaactttactggagngncaattttcattaattcttccacttgncaacatatgcttnnttagcttgggcctctcctttttatacaagccagtcttcagtttctgggangaggctcaaaaaatttggatgaaccngctcacatattaaaattttcatattgggccacacagnttggcttntgaacccaatacncatattccncaccngctttttaacnacattnctttnttttttccaattancttggaattatnatnttacccctnggtnaaanaacaaggtaaaaaaaggngtttccctnccggccaaccaantngggtttaaatgg

SEQ ID NO: 101 - DNA, 723 bp, Homo sapiens
  misc_feature (4)..(4): n is a, c, g, or t/u
  misc_feature (48)..(48): n is a, c, g, or t/u
  misc_feature (74)..(74): n is a, c, g, or t/u
  misc_feature (94)..(94): n is a, c, g, or t/u
  misc_feature (98)..(98): n is a, c, g, or t/u
  misc_feature (100)..(100): n is a, c, g, or t/u
  misc_feature (103)..(103): n is a, c, g, or t/u
  misc_feature (112)..(112): n is a, c, g, or t/u
  misc_feature (124)..(124): n is a, c, g, or t/u
  misc_feature (132)..(132): n is a, c, g, or t/u
  misc_feature (138)..(138): n is a, c, g, or t/u
  misc_feature (140)..(140): n is a, c, g, or t/u
  misc_feature (194)..(195): n is a, c, g, or t/u
  misc_feature (202)..(202): n is a, c, g, or t/u
  misc_feature (214)..(214): n is a, c, g, or t/u
  misc_feature (217)..(217): n is a, c, g, or t/u
  misc_feature (230)..(230): n is a, c, g, or t/u
  misc_feature (233)..(233): n is a, c, g, or t/u
  misc_feature (235)..(235): n is a, c, g, or t/u
  misc_feature (238)..(239): n is a, c, g, or t/u
  misc_feature (251)..(252): n is a, c, g, or t/u
  misc_feature (268)..(268): n is a, c, g, or t/u
  misc_feature (308)..(308): n is a, c, g, or t/u
  misc_feature (312)..(312): n is a, c, g, or t/u
  misc_feature (319)..(319): n is a, c, g, or t/u
  misc_feature (367)..(367): n is a, c, g, or t/u
  misc_feature (403)..(403): n is a, c, g, or t/u
  misc_feature (433)..(433): n is a, c, g, or t/u
  misc_feature (472)..(472): n is a, c, g, or t/u
  misc_feature (495)..(495): n is a, c, g, or t/u
  misc_feature (501)..(501): n is a, c, g, or t/u
  misc_feature (514)..(514): n is a, c, g, or t/u
  misc_feature (553)..(553): n is a, c, g, or t/u
  misc_feature (569)..(569): n is a, c, g, or t/u
  misc_feature (572)..(572): n is a, c, g, or t/u
  misc_feature (591)..(591): n is a, c, g, or t/u
  misc_feature (594)..(594): n is a, c, g, or t/u
  misc_feature (612)..(612): n is a, c, g, or t/u
  misc_feature (619)..(619): n is a, c, g, or t/u
  misc_feature (622)..(622): n is a, c, g, or t/u
  misc_feature (643)..(643): n is a, c, g, or t/u
  misc_feature (646)..(646): n is a, c, g, or t/u
  misc_feature (649)..(649): n is a, c, g, or t/u
  misc_feature (654)..(654): n is a, c, g, or t/u
  misc_feature (657)..(657): n is a, c, g, or t/u
  misc_feature (677)..(678): n is a, c, g, or t/u
  misc_feature (691)..(691): n is a, c, g, or t/u
  misc_feature (697)..(697): n is a, c, g, or t/u
  misc_feature (716)..(716): n is a, c, g, or t/u
ctanggcaaaaatattttattaattgaaggaataggccaatttaaggntatctagtccaagtccatattaacanaatttttctcattagggtancatncnccnttctgatgnggaggttcagcnccaaaatngttttngncttctaaatcttcttcctttttatcaatatttgggccatttggagttctttccnntttgggngattcaattttnggnttcggttgggttncancnggnncacatgtgttgnncaattccttgattttnggttaatttcctgagcacgtacaactggatcctgatcaanactntttttancctgagcattcatgacattattcatccattccatcacttcattaacanacttctccacttttttcatttcaaactcatcaatanggggggatttctcatccttatttctgaagncagctgctatcttggcataatgctgcaacctctgcctanttcttcaaacatttttggccgtncttcancttcctgaaaccnaactttaactggaggccaattttcattaaatttttcccncttgcaacatatgccnggntaacctgggcctctccttnttnatacaaccaggctttaantttttgnggngagtctcaaaaaaaatttganganccngctcncanataaaattttcatatggccnnacagcttgggttntgaacnctacccatattcccaaacngcttttt

SEQ ID NO: 102 - DNA, 724 bp, Homo sapiens
  misc_feature (15)..(15): n is a, c, g, or t/u
  misc_feature (49)..(49): n is a, c, g, or t/u
  misc_feature (75)..(75): n is a, c, g, or t/u
  misc_feature (101)..(101): n is a, c, g, or t/u
  misc_feature (113)..(113): n is a, c, g, or t/u
  misc_feature (116)..(116): n is a, c, g, or t/u
  misc_feature (123)..(123): n is a, c, g, or t/u
  misc_feature (125)..(125): n is a, c, g, or t/u
  misc_feature (133)..(133): n is a, c, g, or t/u
  misc_feature (135)..(135): n is a, c, g, or t/u
  misc_feature (139)..(139): n is a, c, g, or t/u
  misc_feature (141)..(141): n is a, c, g, or t/u
  misc_feature (182)..(182): n is a, c, g, or t/u
  misc_feature (199)..(199): n is a, c, g, or t/u
  misc_feature (203)..(203): n is a, c, g, or t/u
  misc_feature (215)..(215): n is a, c, g, or t/u
  misc_feature (224)..(225): n is a, c, g, or t/u
  misc_feature (247)..(247): n is a, c, g, or t/u
  misc_feature (250)..(250): n is a, c, g, or t/u
  misc_feature (252)..(252): n is a, c, g, or t/u
  misc_feature (269)..(269): n is a, c, g, or t/u
  misc_feature (271)..(271): n is a, c, g, or t/u
  misc_feature (287)..(287): n is a, c, g, or t/u
  misc_feature (314)..(314): n is a, c, g, or t/u
  misc_feature (369)..(369): n is a, c, g, or t/u
  misc_feature (374)..(374): n is a, c, g, or t/u
  misc_feature (572)..(572): n is a, c, g, or t/u
  misc_feature (591)..(591): n is a, c, g, or t/u
  misc_feature (618)..(618): n is a, c, g, or t/u
  misc_feature (649)..(650): n is a, c, g, or t/u
  misc_feature (652)..(652): n is a, c, g, or t/u
  misc_feature (668)..(668): n is a, c, g, or t/u
  misc_feature (689)..(689): n is a, c, g, or t/u
  misc_feature (714)..(714): n is a, c, g, or t/u
cctagggcaaaaatnttttattaattgaaggaataggccaatttaaggntatctagtccaagtccatattaacanaatttttctcattagggtaacattcnccattctgatgnggnggttcancnccaaaatngntttngncttctaaatcttcttcctttttatcaatattggggccattnggagttctttccagttngggngattcaattttnggtttcggnngggttacaacgggttcacatgngtngntcaattccttgattttngntttaatttcctgagcncgtacaactggatcctgatcaaaactntttttagcctgagcattcatgacattattcatccattccatcacttcattaacanacttntccacttttttcatttcaaactcatcaatatggggggatttctcatccttatttctgaagcagctgctatcttggcataatgctgcagcctctgcctagttcttcaaacatttttggccgttcttcagcttcctgaaacccgaactttaactggaggccaattttcattaattcttccaacttgcaacatatgcttgnttaacttggcctctccttnttcatacagccagtctttagtttctgngagggagtctcaaaaaattttggaagaaccnncnccataaaaattttcanatgggccccccagcttggctntgaactcatacacatttccccaacnggcattttaa

SEQ ID NO: 103 - DNA, 401 bp, Homo sapiens
ggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtgga

SEQ ID NO: 104 - DNA, 677 bp, Homo sapiens
  misc_feature (122)..(122): n is a, c, g, or t/u
  misc_feature (132)..(132): n is a, c, g, or t/u
  misc_feature (138)..(138): n is a, c, g, or t/u
  misc_feature (170)..(170): n is a, c, g, or t/u
  misc_feature (196)..(196): n is a, c, g, or t/u
  misc_feature (200)..(200): n is a, c, g, or t/u
  misc_feature (237)..(237): n is a, c, g, or t/u
  misc_feature (247)..(247): n is a, c, g, or t/u
  misc_feature (268)..(268): n is a, c, g, or t/u
  misc_feature (284)..(284): n is a, c, g, or t/u
  misc_feature (311)..(311): n is a, c, g, or t/u
  misc_feature (371)..(371): n is a, c, g, or t/u
  misc_feature (376)..(376): n is a, c, g, or t/u
  misc_feature (390)..(390): n is a, c, g, or t/u
  misc_feature (405)..(405): n is a, c, g, or t/u
  misc_feature (425)..(425): n is a, c, g, or t/u
  misc_feature (441)..(441): n is a, c, g, or t/u
  misc_feature (460)..(460): n is a, c, g, or t/u
  misc_feature (464)..(464): n is a, c, g, or t/u
  misc_feature (474)..(474): n is a, c, g, or t/u
  misc_feature (525)..(525): n is a, c, g, or t/u
  misc_feature (554)..(554): n is a, c, g, or t/u
  misc_feature (566)..(566): n is a, c, g, or t/u
  misc_feature (570)..(570): n is a, c, g, or t/u
  misc_feature (573)..(573): n is a, c, g, or t/u
  misc_feature (604)..(604): n is a, c, g, or t/u
  misc_feature (611)..(611): n is a, c, g, or t/u
  misc_feature (617)..(617): n is a, c, g, or t/u
  misc_feature (622)..(622): n is a, c, g, or t/u
  misc_feature (636)..(636): n is a, c, g, or t/u
  misc_feature (642)..(642): n is a, c, g, or t/u
  misc_feature (644)..(644): n is a, c, g, or t/u
  misc_feature (657)..(657): n is a, c, g, or t/u
  misc_feature (667)..(667): n is a, c, g, or t/u
atggcaaaaatattttattaattgaaggaataggccaatttaaggttatctagtccaagtccatattaacagaatttttctcattagggtaacattcaccattctgatgtggaggttcaccnccaaaattgnttttgncttctaaatcttcttcctttttatcaatattngggccatttggagttctttccagttngggngattcaatttttggtttcggttgggttacaacgggtncacatgtgtnggtcaattccttgatttttgntttaatttcctgagcncgtacaactggatcctgatcaagactntttttagcctgagcattcatgacattattcatccattccatcacttcattaacagacttntccanttttttcatttcanactcatcaatatggngggatttctcatccttattnctgaagtcagctgctntcttggcataatgctgcancctntgcctagttnttcaaacattttgggccgttcttcagcttcctgaaccgaactttaactggnggccaatttcattaaattttccacttggnacaaatgcttgntaanctngggcctctccttttcaaacaaccggctttantttttgnggggangttcnaaaaatttgaagancccgcncncattaaaattttnatatggcccnacagcttggg

SEQ ID NO: 105 - DNA, 659 bp, Homo sapiens
  misc_feature (630)..(630): n is a, c, g, or t/u
agctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaangatatttagaaattttgtgtattatatgg

SEQ ID NO: 106 - DNA, 516 bp, Homo sapiens
  misc_feature (193)..(193): n is a, c, g, or t/u
  misc_feature (214)..(214): n is a, c, g, or t/u
  misc_feature (218)..(218): n is a, c, g, or t/u
  misc_feature (227)..(227): n is a, c, g, or t/u
  misc_feature (235)..(235): n is a, c, g, or t/u
  misc_feature (247)..(248): n is a, c, g, or t/u
  misc_feature (252)..(252): n is a, c, g, or t/u
  misc_feature (327)..(327): n is a, c, g, or t/u
  misc_feature (375)..(375): n is a, c, g, or t/u
  misc_feature (504)..(504): n is a, c, g, or t/u
gagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaangagaggaccaagctaaacaancatntgtcgacangttggaanaattaatgaaanntggnactccagttaaagttcggtttcaggaagctgaagaacggccaaaaatgtttgaagaactaggacagaggctgcancattatgccaagatagcagctgacttcaagaaataaggatgagaaatncaaccatattgatgagtctgaaatgaaaaaagtggagaagtctgttaatgaagtgatggaatggatgaataatgtcatgaatgctcatgctaaaaagagtcttgatcaggatccagttgtacgtgctcnggaaattaaaac

SEQ ID NO: 107 - DNA, 347 bp, Homo sapiens
ggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatag

SEQ ID NO: 108 - DNA, 795 bp, Homo sapiens
  misc_feature (639)..(639): n is a, c, g, or t/u
  misc_feature (654)..(654): n is a, c, g, or t/u
  misc_feature (741)..(741): n is a, c, g, or t/u
  misc_feature (751)..(751): n is a, c, g, or t/u
  misc_feature (777)..(777): n is a, c, g, or t/u
ctgaggaagtgggacctccccttttgggtcggtagttcagcgccggcgccggtgtgcgagccgcggcagagtgaggcaggcaacccgaggtgcggagcgacctgcggaggctgagccccgctttctcccagggtttcttatcagccagccgccgctgtccccgggggagtaggaggctcctgacaggccgcggctgtctgtgtgtccttctgagtgtcagaggaacggccagaccccgcgggccggagcagaacgcggccagggcagaaagcggcggcaggagaagcaggcagggggccggaggacgcagaccgagacccgaggcggaggcggaccgcgagccggccatgtcggtggtggggttggacgtgggctcgcagagctgctacatcgcggtagcccgggccgggggcatcgagaccatcgccaatgagttcagcgaccggtgcaccccgtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggaaaaaggaaaacttgagttacgatttggttccattgaaaaatggnggagttggaataaangtaatgtacatgggtgaaagaacatctatttagtgtggaggcagataacaagccatgttgttgaacttaacttgaaaggaaactggntgaaaacagncttcaaaaaaccaataacaaaatggngttatttcaatccccttc

SEQ ID NO: 109 - DNA, 580 bp, Homo sapiens
  misc_feature (10)..(10): n is a, c, g, or t/u
  misc_feature (385)..(385): n is a, c, g, or t/u
  misc_feature (432)..(432): n is a, c, g, or t/u
  misc_feature (444)..(444): n is a, c, g, or t/u
  misc_feature (491)..(491): n is a, c, g, or t/u
  misc_feature (526)..(526): n is a, c, g, or t/u
  misc_feature (571)..(571): n is a, c, g, or t/u
agaaatgacnccataagatgaactttattttaaagctcataaaagtgttcacaatcagttacaacaggatcgacatttcttccattccacactttcacatgacaatatactgtatagtgagagagaaagtttaaagtttttgttctgcatgctgctaacacatttgactagcttttgttttactcattgaatttttaatatcaaagcaaaaagtcattttctcttggacagaaatggttttagaaagcccttatgaagtcagacttagtcttgtttataaacatccacacccacacacatgctgaatggagagcaaaatgcaagaaaactaccttggcaggaacaaatgcttaaagattttaatcacagccctcttgaacaagcngtacagttttttttctccaaaagacaaaagtcagtttcatcctcagngatgcaaatggngagactgcacagaaagcttagtatgaattcacaattccacaggaatntgaaagttaccaaggcaattttcccttttaggatnataaagactacagacttaagcttttttctttttccatataatacncaaaaattt

SEQ ID NO: 110 - DNA, 781 bp, Homo sapiens
  misc_feature (2)..(2): n is a, c, g, or t/u
  misc_feature (48)..(48): n is a, c, g, or t/u
  misc_feature (79)..(79): n is a, c, g, or t/u
  misc_feature (181)..(181): n is a, c, g, or t/u
  misc_feature (223)..(223): n is a, c, g, or t/u
  misc_feature (243)..(243): n is a, c, g, or t/u
  misc_feature (274)..(274): n is a, c, g, or t/u
  misc_feature (354)..(354): n is a, c, g, or t/u
  misc_feature (382)..(382): n is a, c, g, or t/u
  misc_feature (439)..(439): n is a, c, g, or t/u
  misc_feature (445)..(445): n is a, c, g, or t/u
  misc_feature (453)..(453): n is a, c, g, or t/u
  misc_feature (457)..(457): n is a, c, g, or t/u
  misc_feature (502)..(502): n is a, c, g, or t/u
  misc_feature (522)..(522): n is a, c, g, or t/u
  misc_feature (537)..(537): n is a, c, g, or t/u
  misc_feature (574)..(574): n is a, c, g, or t/u
  misc_feature (619)..(619): n is a, c, g, or t/u
  misc_feature (629)..(629): n is a, c, g, or t/u
  misc_feature (640)..(640): n is a, c, g, or t/u
  misc_feature (644)..(644): n is a, c, g, or t/u
  misc_feature (681)..(681): n is a, c, g, or t/u
  misc_feature (687)..(687): n is a, c, g, or t/u
  misc_feature (700)..(700): n is a, c, g, or t/u
  misc_feature (704)..(704): n is a, c, g, or t/u
  misc_feature (707)..(707): n is a, c, g, or t/u
  misc_feature (719)..(719): n is a, c, g, or t/u
  misc_feature (738)..(738): n is a, c, g, or t/u
  misc_feature (745)..(745): n is a, c, g, or t/u
  misc_feature (747)..(747): n is a, c, g, or t/u
  misc_feature (750)..(750): n is a, c, g, or t/u
  misc_feature (756)..(756): n is a, c, g, or t/u
  misc_feature (769)..(769): n is a, c, g, or t/u
  misc_feature (776)..(776): n is a, c, g, or t/u
anaaatgacaccataagatgaactttattttaaagctcataaaagtgntcacaatcagttacaacaggatcgacatttnttccattccacactttcacatgacaatatactgtatagcgagagagaaagtttaaagtttttgttctgcatgctgctaacacatttgactagcttttggttnactcattgaatttttaatatcaaagcaaaaagtcattttctnttggacagaaatggttttanaaagcccttatgaagtcagacttagtcttgngttataaacatccacacccacacacatgctgaatggagagcaaaatgcaagaaaactaccttggcaggaacaaatgcttnaagattttaatcacagccctcttgaacnagcagtcacgttttttttctccaaaagacaaaagtcagtttcatcctcagtgatgcnaatggngagactgnacanaaagcttagtatgaattcacaattcacaggaatctgaaagttccnaggcaattttccttttaggngtcattaagactccngacttaagctttttttctttttccatataaacaccanaatttctaaatattcttaaaaaagaaaatataaatagtttcaatntgttatgtanagtacatactntggngaaaatttttttttaattgaaggaataggcccatttnagggtntttaatccaagtncctnttnacaaaatttttntattaggggaacatccccnttttgangnggngggtcnaccccaaaatggntttggcnttaaa

SEQ ID NO: 111 - DNA, 462 bp, Homo sapiens
  misc_feature (214)..(214): n is a, c, g, or t/u
  misc_feature (252)..(252): n is a, c, g, or t/u
  misc_feature (292)..(292): n is a, c, g, or t/u
  misc_feature (340)..(340): n is a, c, g, or t/u
  misc_feature (392)..(392): n is a, c, g, or t/u
  misc_feature (401)..(401): n is a, c, g, or t/u
  misc_feature (410)..(410): n is a, c, g, or t/u
  misc_feature (420)..(420): n is a, c, g, or t/u
  misc_feature (436)..(436): n is a, c, g, or t/u
cagcgccggcgccggtgtgcgagccgcggcagagtgaggcaggcaacccgaggtgcggagcgacctgcggaggctgagccccgctttctcccagggtttcttatcagccagccgccgctgtccccgggggagtaggaggctcctgacaggccgcggctgtctgtgtgtccttctgagtgtcagaggaacggccagaccccgcgggccggagcanaacgcggccagggcagaaagcggcggcaggagaagcangcagggggccggaggacgcagaccgagacccgaggcggangcggaccgcgagccggccatgtcggtggtggggttggacgtgggctcncagagctgctacatcgcggtagcccgggccgggggcatcgagaccatcgccnatgagttcngcgaccggngcaccccgtnagtcatatcatttggntcaaaaaatataaacaaatcggagtt

SEQ ID NO: 112 - DNA, 688 bp, Homo sapiens
  misc_feature (524)..(524): n is a, c, g, or t/u
  misc_feature (581)..(581): n is a, c, g, or t/u
  misc_feature (616)..(616): n is a, c, g, or t/u
  misc_feature (646)..(646): n is a, c, g, or t/u
  misc_feature (667)..(667): n is a, c, g, or t/u
gggaatgtgtgcaagtgggggcctgtgcatgtgagtgtgtggtgtgcatgtgggaatgtgtgcaagtgggcgcctgtgcgagtgtgtggtgtgtgtgtgggaatgtgtgcaagtgggcgcctgtgcgagtgtgtggtgcgtgtgtgggaatgtgtgcaagtgggcgcctgcccatgtgagtgtgtggtgcgtgtgttggaatgtgtgcaagtggacgcctgcgcatgtgagtgtgtggtgcgtgtgggaatgtgtgcaagtgggcacctgtgcgagtgtgtggtgcgcgtgtgggaatgtgtgcaagtgggcacctgcccatgggagtgtgtggtgcgcgtgtgggaatgtgtgcaagtgggagcctgcgcatgtgagtgtgaggacacctcgtgctcaggtgtcaccaaccccatttaaaaaggaaataactatgatgacaaccagtctctagtgtacgatctgatcgagataccacttcctcatctagcaagtgagcttggctcaggtcttttaaagcacangtaggccctgaagaaattcagcttcagtccgaacctctgtgcctgcaggtgatgaanacttggggctcattccaatgccaagagcccatganactcctcctgccagatacctgagtcaaaancttaaaagagcggggcaaganaaccagaaaaaattaggggaa

SEQ ID NO: 113 - DNA, 755 bp, Homo sapiens
  misc_feature (118)..(118): n is a, c, g, or t/u
  misc_feature (445)..(445): n is a, c, g, or t/u
  misc_feature (540)..(540): n is a, c, g, or t/u
  misc_feature (633)..(633): n is a, c, g, or t/u
  misc_feature (702)..(702): n is a, c, g, or t/u
  misc_feature (726)..(726): n is a, c, g, or t/u
  misc_feature (735)..(735): n is a, c, g, or t/u
agaaatgacaccataagatgaactttattttaaagctcataaaagtgttcacaatcagttacaacaggatcgacatttcttccattccacactttcacatgacaatatactgtatagngagagagaaagtttaaagtttttgttctgcatgctgctaacacatttgactagcttttgttttactcattgaatttttaatatcaaagcaaaaagtcattttctcttggacagaaatggttttagaaagcccttatgaagtcagacttagtcttgtttataaacatccacacccacacacatgctgaatggagagcaaaatgcaagaaaactaccttggcaggaacaaatgcttaaagattttaatcacagccctcttgaacaagcagtacaagttttttttctccaaaagacaaaagtcagtttcatcctcagtgatgcaaatggngagactgcacagaaagcttagtatgaattcacaattccacaggaatctgaaagttaccaaggcaattttcccttttaggatcataaagactacanacttaaagctttttttctttttccatataatacacaaaatttctaaatatccttaaaaaagaaaatataaatagtttcaggtatgttatgtanagtcacatactatggcaaaaatttttattaattggaaggaataggcccatttaagggtatctagtccangtccttattaacaagaattttttnatttggggnaacattcaccattcttgatg

SEQ ID NO: 114 - DNA, 726 bp, Homo sapiens
  misc_feature (641)..(641): n is a, c, g, or t/u
  misc_feature (715)..(715): n is a, c, g, or t/u
gagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttctttttttaangatatttagaaattttgggtattatatggaaaaagaaaaaaagcttaagtctgtagtctttttgatcctaaaangggaaaattgg

SEQ ID NO: 115 - DNA, 1889 bp, Homo sapiens
  misc_feature (252)..(252): n is a, c, g, or t/u
  misc_feature (1554)..(1554): n is a, c, g, or t/u
  misc_feature (1587)..(1587): n is a, c, g, or t/u
ccctggacatggctccagagatcaacttgccgggcccaatgagcctcattgataacactaaagggcagctggtggtgaatccagaagctctgaagatcctatctgcaattacgcagcctgtggtggtggtggcgattgtgggcctctatcgcacaggcaaatcctacctgatgaacaagctggctgggaagaaaaacggcttctctctaggctccacagtgaagtctcacaccaagggaatctggatgtggngtgtgcctcatcccaagaagccagaacacaccctagttctgctcgacactgagggcctgggagatatagagaagggtgacaatgagaatgactcctggatctttgccttggccatcctcctgagcagcaccttcgtgtacaatagcatgggaaccatcaaccagcaggccatggaccaacttcactatgtgacagagctgacagatcgaatcaaggcaaactcctcacctggtaacaattctgtagacgactcagctgactttgtgagcttttttccagcatttgtgtggactctcagagatttcaccctggaactggaagtagatggagaacccatcactgctgatgactacttggagctttcgctaaagctaagaaaaggtactgataagaaaagtaaaagctttaatgatcctcggttgtgcatccgaaagttcttccccaagaggaagtgcttcgtcttcgattggcccgctcctaagaagtaccttgctcacctagagcagctaaaggaggaagagctgaaccctgatttcatagaacaagttgcagaattttgttcctacatcctcagccattccaatgtcaagactctttcaggtggcattgcagtcaatgggcctcgtctagagagcctggtgctgacctacgtcaatgccatcagcagtggggatctaccctgcatggagaacgcagtcctggccttggcccagatagagaactcagccgcagtggaaaaggctattgcccactatgaacagcagatgggccagaaggtgcagctgcccacggaaaccctccaggagctgctggacctgcacagggacagtgagagagaggccattgaagtcttcatgaagaactctttcaaggatgtggaccaaatgttccagaggaaattaggggcccagttggaagcaaggcgagatgacttttgtaagcagaattccaaagcatcatcagattgttgcatggctttacttcaggatatatttggccctttagaagaagatgtcaagcagggaacattttctaaaccaggaggttaccgtctctttactcaaaagctgcaggagctgaagaataagtctaccagggccaaggaaggggatacaggccaaagaggtgctgaaaaaatatttggagtccaaggaggatgtggctgatgcacttctacagacttgatcagtcactctcagaaaaggaaaaagcgattgaagtggaacgtataaaggctgaatctgcagaagctgcaaagaaaatgttggaggaaatacaaaagaagaatgaggagatgatggncagaaagagaagagttatcaggaacatgtgaancaattgactgagaagatggagagggacagggcccagttaatggcagagcaagagaagaccctcgctcttaaacttcaggaacaggaacgccttctcaaggagggattcgagaatgagagcaagagacttcaaaaagacatatgggatatccagatgagaagcaaatcattggagccaatatgtaacatactctaaaagtccaaggagcaaaatttgcctgtccagctccctctccccaagaaacaacatgaatgagcaacttcagagtgtcaaacaactgccattaaacttaactcaaaatc

SEQ ID NO: 116 - DNA, 791 bp, Homo sapiens
  misc_feature (252)..(252): n is a, c, g, or t/u
  misc_feature (475)..(475): n is a, c, g, or t/u
  misc_feature (507)..(507): n is a, c, g, or t/u
  misc_feature (552)..(552): n is a, c, g, or t/u
  misc_feature (620)..(620): n is a, c, g, or t/u
  misc_feature (632)..(632): n is a, c, g, or t/u
  misc_feature (639)..(640): n is a, c, g, or t/u
  misc_feature (644)..(644): n is a, c, g, or t/u
  misc_feature (658)..(658): n is a, c, g, or t/u
  misc_feature (678)..(678): n is a, c, g, or t/u
  misc_feature (684)..(684): n is a, c, g, or t/u
  misc_feature (709)..(709): n is a, c, g, or t/u
  misc_feature (725)..(725): n is a, c, g, or t/u
  misc_feature (761)..(761): n is a, c, g, or t/u
  misc_feature (766)..(766): n is a, c, g, or t/u
  misc_feature (777)..(777): n is a, c, g, or t/u
  misc_feature (784)..(784): n is a, c, g, or t/u
ccctggacatggctccagagatcaacttgccgggcccaatgagcctcattgataacactaaagggcagctggtggtgaatccagaagctctgaagatcctatctgcaattacgcagcctgtggtggtggtggcgattgtgggcctctatcgcacaggcaaatcctacctgatgaacaagctggctgggaagaaaaacggcttctctctaggctccacagtgaagtctcacaccaagggaatctggatgtggngtgtgcctcatcccaagaagccagaacacaccctagttctgctcgacactgagggcctgggagatatagagaagggtgacaatgagaatgactcctggatctttgccttggccatcctcctgagcagcaccttcgtgtacaatagcatgggaaccatcaaccagcaggccatggaccaacttcactatgtgacagagctgacagatcgaatcaaggcaaactnctcacctggtaacaattctgtagacgactcanctgactttgtgagcttttttccagcatttgtgtggactcttaaanatttcaccctggaactgggaagtagatggagaacccatcactgctgatgactactttggagcttttcnctaaaagctaanaaaaagnnctgnataaaaaaaaagtnaaagcttttatgaatccttnggtggngcatccgaaaagtttcttccccaanaaggaagtggcttcgnctttcaattggggcccgctcctaaaaaagacccttncttcncttgaagccancttaaanggaggaa

SEQ ID NO: 117 - DNA, 551 bp, Homo sapiens
  misc_feature (361)..(361): n is a, c, g, or t/u
  misc_feature (485)..(485): n is a, c, g, or t/u
  misc_feature (509)..(509): n is a, c, g, or t/u
gattttgagttaagtttaatggcagttgtttgacactctgaagttgctcattcatgttgtttcttggggagagggagctggacaggcaaattttgctccttggacttttagagtatgttacatattggctccaatgatttgcttctcatctggatatcccatatgtctttttgaagtctcttgctctcattctcgaatccctccttgagaaggcgttcctgttcctgaagtttaagagcgagggtcttctcttgctctgccattaactgggccctgtccctctccatcttctcagtcaattgtttcacatgttcctgataactcttctctttctgttccatcatctcctcattcttctttngtatttcctccaacattttctttgcagcttctgcagattcagcctttatacgttccacttcaatcgctttttccttttctgagagtgactgatcagtctgtagaagtgcatcagccacatcctncttggactccaaatattttttcancacctctttggccttgtatccccttcctttggcacctgggga

SEQ ID NO: 118 - DNA, 824 bp, Homo sapiens
  misc_feature (624)..(624): n is a, c, g, or t/u
  misc_feature (639)..(639): n is a, c, g, or t/u
  misc_feature (706)..(706): n is a, c, g, or t/u
  misc_feature (717)..(717): n is a, c, g, or t/u
  misc_feature (720)..(720): n is a, c, g, or t/u
  misc_feature (735)..(735): n is a, c, g, or t/u
  misc_feature (760)..(760): n is a, c, g, or t/u
  misc_feature (800)..(800): n is a, c, g, or t/u
ccatcctcctgagcagcaccttcgtgtacaatagcatgggaaccatcaaccagcaggccatggaccaacttcactatgtgacagagctgacagatcgaatcaaggcaaactcctcacctggtaacaattctgtagacgactcagctgactttgtgagcttttttccagcatttgtgtggactctcagagatttcaccctggaactggaagtagatggagaacccatcactgctgatgactacttggagctttcgctaaagctaagaaaaggtactgataagaaaagtaaaagctttaatgatcctcggttgtgcatccgaaagttcttccccaagaggaagtgcttcgtcttcgattggcccgctcctaagaagtaccttgctcacctagagcagctaaaggaggaagagctgaaccctgatttcatagaacaagttgcagaattttgttcctacatcctcagccattccaatgtcaagactctttcaggtggcattgcagtcaatgggcctcgtctagagagcctggtgctgacctacgtcaatgccatcggcagtggggatctaccctgcatggagaacgcagtcctggccttggcccagatagaagaactcagcccgcagnggaaaaggctattgnccacttatgaacagcaagatggggccagaaggggcagctgcccaccggaaacccttccaggagctgntgggacctgcncanggacagtgagaaaanaggccattgaagtctttattgaaanaacttttttcaaggatgtgggaccaaatggttccaaaggnaaattagggggcccaatttgggaa

SEQ ID NO: 119 - DNA, 756 bp, Homo sapiens
  misc_feature (4)..(4): n is a, c, g, or t/u
  misc_feature (30)..(31): n is a, c, g, or t/u
  misc_feature (33)..(33): n is a, c, g, or t/u
  misc_feature (39)..(39): n is a, c, g, or t/u
  misc_feature (180)..(180): n is a, c, g, or t/u
  misc_feature (199)..(199): n is a, c, g, or t/u
  misc_feature (213)..(213): n is a, c, g, or t/u
  misc_feature (218)..(218): n is a, c, g, or t/u
  misc_feature (240)..(240): n is a, c, g, or t/u
  misc_feature (242)..(242): n is a, c, g, or t/u
  misc_feature (253)..(253): n is a, c, g, or t/u
  misc_feature (255)..(255): n is a, c, g, or t/u
  misc_feature (281)..(281): n is a, c, g, or t/u
  misc_feature (286)..(286): n is a, c, g, or t/u
  misc_feature (292)..(292): n is a, c, g, or t/u
  misc_feature (295)..(295): n is a, c, g, or t/u
  misc_feature (299)..(299): n is a, c, g, or t/u
  misc_feature (307)..(307): n is a, c, g, or t/u
  misc_feature (327)..(327): n is a, c, g, or t/u
  misc_feature (403)..(403): n is a, c, g, or t/u
  misc_feature (451)..(451): n is a, c, g, or t/u
  misc_feature (467)..(467): n is a, c, g, or t/u
  misc_feature (511)..(511): n is a, c, g, or t/u
  misc_feature (535)..(535): n is a, c, g, or t/u
  misc_feature (544)..(544): n is a, c, g, or t/u
  misc_feature (565)..(565): n is a, c, g, or t/u
  misc_feature (586)..(586): n is a, c, g, or t/u
  misc_feature (601)..(601): n is a, c, g, or t/u
  misc_feature (618)..(618): n is a, c, g, or t/u
  misc_feature (629)..(629): n is a, c, g, or t/u
  misc_feature (632)..(632): n is a, c, g, or t/u
  misc_feature (647)..(647): n is a, c, g, or t/u
  misc_feature (660)..(660): n is a, c, g, or t/u
  misc_feature (662)..(662): n is a, c, g, or t/u
  misc_feature (693)..(693): n is a, c, g, or t/u
  misc_feature (702)..(702): n is a, c, g, or t/u
  misc_feature (718)..(718): n is a, c, g, or t/u
  misc_feature (720)..(720): n is a, c, g, or t/u
gggngattttgagttaagtttaatggcagnngnttgacnctctgaagttgctcattcatgttgtttcttggggagagggagctggacaggcaaattttgctccttggacttttaaagtatgttacatattggctccaatgatttgcttctcatctggatatcccatatgtctttttgaantctcttgctctcattctcnaatccctccttganaaggngttcctgttcctgaagtttaanancgaggggcttntnttgctctgccattaactgggccctgnccctntccatnttntcantcaattgnttcacatgttcctgataacncttctctttctggtccatcatctcctcattcttcttttggatttcctccaacattttctttgcagcttctgcagantcaacctttatacgttccacttcaatcgctttttccttttctgagagngactgatcagctgtanaagtgcatcaaccacatccttcttggactccaaatattttttcnccctctttggcctgtatccccttncttggcccngggagacttattctttaactnctgcagcttttgaggaaaaanacgggacctcctggnttaaaaaaagtccctgnttgacatcttnttntaaggggccaatatntcctgaagaaaancntgccaccaatctgatgatgcttggaaattgnttacaaaanaatttgcctggttcancngggccctaattccctggaacattgggcccaaccttg

SEQ ID NO: 120 - DNA, 916 bp, Homo sapiens
  misc_feature (661)..(661): n is a, c, g, or t/u
  misc_feature (669)..(669): n is a, c, g, or t/u
  misc_feature (674)..(674): n is a, c, g, or t/u
  misc_feature (692)..(692): n is a, c, g, or t/u
  misc_feature (708)..(708): n is a, c, g, or t/u
  misc_feature (727)..(727): n is a, c, g, or t/u
  misc_feature (738)..(738): n is a, c, g, or t/u
  misc_feature (805)..(805): n is a, c, g, or t/u
  misc_feature (819)..(819): n is a, c, g, or t/u
  misc_feature (825)..(825): n is a, c, g, or t/u
  misc_feature (832)..(832): n is a, c, g, or t/u
  misc_feature (835)..(835): n is a, c, g, or t/u
  misc_feature (858)..(858): n is a, c, g, or t/u
  misc_feature (864)..(864): n is a, c, g, or t/u
  misc_feature (875)..(875): n is a, c, g, or t/u
  misc_feature (899)..(899): n is a, c, g, or t/u
gcccaatgagcctcattgataacactaaagggcagctggtggtgaatccagaagctctgaagatcctatctgcaattacgcagcctgtggtggtggtggcgattgtgggcctctatcgcacaggcaaatcctacctgatgaacaagctggctgggaagaaaaacggcttctctctaggctccacagtgaagtctcacaccaagggaatctggatgtggtgtgtgcctcatcccaagaagccagaacacaccctagttctgctcgacactgagggcctgggagatatagagaagggtgacaatgagaatgactcctggatctttgccttggccatcctcctgagcagcaccttcgtgtacaatagcatgggaaccatcaaccagcaggccatggaccaacttcactatgtgacagagctgacagatcgaatcaaggcaaactcctcacctggtaacaattctgtagacgactcagctgactttgtgagcttttttccagcatttgtgtggactctcagagatttcaccctggaactggaagtagatggagaacccatcactgctgatgactacttggagctttcgctaaagctaagaaaaggtactgataaagaaaagtaaaagctttaatgatcctcgggtggcattccgaaaagttcttncccaagangaagngcttcgtcttcgattggnccgcttccttaaaaantaccttggctcacccttanagcagcttaanggaggaagaagcttgaacccttgattttattaaaacaaaggtggcagaaattttggttccttcattncctcaagccctttncaatgntcaaaanctnttttcaaggggggatttgcaagnccaatnggggcctcgtnttaaaaaaaacctgggggcttgancttaccgtcaatggccc

SEQ ID NO: 121 - DNA, 787 bp, Homo sapiens
  misc_feature (303)..(303): n is a, c, g, or t/u
  misc_feature (362)..(362): n is a, c, g, or t/u
  misc_feature (462)..(462): n is a, c, g, or t/u
  misc_feature (472)..(472): n is a, c, g, or t/u
  misc_feature (479)..(479): n is a, c, g, or t/u
  misc_feature (505)..(505): n is a, c, g, or t/u
  misc_feature (558)..(558): n is a, c, g, or t/u
  misc_feature (570)..(570): n is a, c, g, or t/u
  misc_feature (588)..(588): n is a, c, g, or t/u
  misc_feature (592)..(592): n is a, c, g, or t/u
  misc_feature (656)..(656): n is a, c, g, or t/u
  misc_feature (658)..(658): n is a, c, g, or t/u
  misc_feature (675)..(675): n is a, c, g, or t/u
  misc_feature (720)..(720): n is a, c, g, or t/u
  misc_feature (726)..(726): n is a, c, g, or t/u
  misc_feature (736)..(736): n is a, c, g, or t/u
  misc_feature (759)..(759): n is a, c, g, or t/u
  misc_feature (768)..(768): n is a, c, g, or t/u
gattttgagttaagtttaatggcagttgtttgacactctgaagttgctcattcatgttgtttcttggggagagggagctggacaggcaaattttgctccttggacttttagagtatgttacatattggctccaatgatttgcttctcatctggatatcccatatgtctttttgaagtctcttgctctcattctcgaatccctccttgagaaggcgttcctgttcctgaagtttaagagcgagggtcttctcttgctctgccattaactgggccctgtccctctccatcttctcagtcaattgnttcacatgttcctgataactcttctctttctggccatcatctcctcattcttcttttgnatttcctccaacattttctttgcagcttctgcaaattcagcctttataccgtccacttcaatcgctttttcctttttgaaaagtgactgacagtctgtanaagtgcatanccccatnctccttggactccaaatattttttcncacctctttggccgggaggttacctgtatccccttccttgggcaccctgggangacttattcttnagctcctgcactttgagnaaanaaccggaacctcctgggttaaaaaaatggtccctgttgacaatcttttttaaaagggcccaaantnttcttgaagtaaagccntgccacaaatctgatgatgcctttggaattctgcttacaaaaatnatcttncccttggttncaactggggccctaaattccttnggacaattnggcccccatccttggaaaa

SEQ ID NO: 122 - DNA, 942 bp, Homo sapiens
  misc_feature (362)..(362): n is a, c, g, or t/u
  misc_feature (526)..(526): n is a, c, g, or t/u
  misc_feature (535)..(535): n is a, c, g, or t/u
  misc_feature (547)..(547): n is a, c, g, or t/u
  misc_feature (550)..(550): n is a, c, g, or t/u
  misc_feature (591)..(591): n is a, c, g, or t/u
  misc_feature (597)..(597): n is a, c, g, or t/u
  misc_feature (615)..(615): n is a, c, g, or t/u
  misc_feature (653)..(653): n is a, c, g, or t/u
  misc_feature (706)..(706): n is a, c, g, or t/u
  misc_feature (711)..(711): n is a, c, g, or t/u
  misc_feature (715)..(715): n is a, c, g, or t/u
  misc_feature (739)..(739): n is a, c, g, or t/u
  misc_feature (761)..(761): n is a, c, g, or t/u
  misc_feature (770)..(770): n is a, c, g, or t/u
  misc_feature (776)..(776): n is a, c, g, or t/u
  misc_feature (787)..(787): n is a, c, g, or t/u
  misc_feature (790)..(790): n is a, c, g, or t/u
  misc_feature (805)..(805): n is a, c, g, or t/u
  misc_feature (814)..(814): n is a, c, g, or t/u
  misc_feature (827)..(827): n is a, c, g, or t/u
  misc_feature (843)..(844): n is a, c, g, or t/u
  misc_feature (862)..(862): n is a, c, g, or t/u
  misc_feature (865)..(865): n is a, c, g, or t/u
  misc_feature (873)..(873): n is a, c, g, or t/u
  misc_feature (882)..(882): n is a, c, g, or t/u
  misc_feature (901)..(901): n is a, c, g, or t/u
  misc_feature (910)..(910): n is a, c, g, or t/u
gattttgagttaagtttaatggcagttgtttgacactctgaagttgctcattcatgttgtttcttggggggagggagctggacaggcaaattttgctccttggacttttagagtatgttacatattggctccaatgatttgcttctcatctggatatcccatatgtctttttgaagtctcttgctctcattctcgaatccctccttgagaaggcgttcctgttcctgaagtttaagagcgagggtcttctcttgctctgccattaactgggccctgtccctctccatcttctcagtcaattgtttcacatgttcctgataactcttctctttctggccatcatctcctcattcttcttttgnatttcctccaacattttctttgcagcttctgcagattcagcctttataccgttccacttcaatcgctttttccttttctgagagtgactgatcaagtctgtagaagtgcatcaaccacatcctccttggactccaaatattttttcagcacctctttggcctgnatccccttncttggccctggnagncttattcttcagctcctgcagcttctgagtaaaaaaaccgnaacctnctgggttaaaaaaaggtncctgcttgacatcttcttctaaaagggccaaatatatnctgaagtaaagcctgccacaatctgatgaagctttggaattctgttacaaaangcatntcgncttgcttccactgggccctaattnctttggaacatttgggcccatncttgaaaanattttnatgaaaacttnaanggccttttttactgncctgggganggccacaactctngggggttcccgggcanntgccctttggccattgtngtnaaaggggnaaaactttnccgggggtgagtttttttnggccaggcnaactggtttcctccgggaaaccccctgccagg

SEQ ID NO: 123 - DNA, 894 bp, Homo sapiens
  misc_feature (600)..(600): n is a, c, g, or t/u
  misc_feature (681)..(681): n is a, c, g, or t/u
  misc_feature (703)..(703): n is a, c, g, or t/u
  misc_feature (716)..(716): n is a, c, g, or t/u
  misc_feature (737)..(737): n is a, c, g, or t/u
  misc_feature (749)..(749): n is a, c, g, or t/u
  misc_feature (768)..(768): n is a, c, g, or t/u
  misc_feature (775)..(775): n is a, c, g, or t/u
  misc_feature (786)..(786): n is a, c, g, or t/u
  misc_feature (796)..(796): n is a, c, g, or t/u
  misc_feature (826)..(826): n is a, c, g, or t/u
ctaagaagtaccttgctcacctagagcagctaaaggaggaagagctgaaccctgatttcatagaacaagttgcagaattttgttcctacatcctcagccattccaatgtcaagactctttcaggtctagagagcctggtgctgacctacgtcaatgccatcagcagtggggatctaccctgcatggagaacgcagtcctggccttggcccagatagagaactcagccgcagtggaaaaggctattgcccactatgaacagcagatgggccagaaggtgcagctgcccacggaaaccctccaggagctgctggacctgcacagggacagtgagagagaggccattgaagtcttcatgaagaactctttcaaggatgtggaccaaatgttccagaggaaattaggggcccagttggaagcaaggcgagatgacttttgtaagcagaattccaaagcatcatcagattgttgcatggctttacttcaggatatatttggccctttagaagaagatgtcaagcagggaacattttctaaaccaggaggttaccgtctctttactcagaagctgcagggagctgaagaataaagtactaccaggngccaaggaaggggatacaggccaaagaggtgctgaaaaaatatttgggagtccaagggaggatgttggcttgatgcccttnttacagactggattcagttccnttctccagaaaanggaaaaagccgatttggaagntgggaacggtantaaaaggcttgaaattttncagaaancctggcaaaanaaaaatgttnggggggaaaatcccaaaagaaagaattggngggggatgattggaacccgaaaaggagaaaaagtttttcagggaaacatgttgaaacaatttgacttg

SEQ ID NO: 124 - DNA, 845 bp, Homo sapiens
  misc_feature (303)..(303): n is a, c, g, or t/u
  misc_feature (336)..(336): n is a, c, g, or t/u
  misc_feature (633)..(633): n is a, c, g, or t/u
  misc_feature (635)..(635): n is a, c, g, or t/u
  misc_feature (638)..(638): n is a, c, g, or t/u
  misc_feature (666)..(666): n is a, c, g, or t/u
  misc_feature (707)..(707): n is a, c, g, or t/u
  misc_feature (714)..(714): n is a, c, g, or t/u
  misc_feature (761)..(761): n is a, c, g, or t/u
  misc_feature (782)..(782): n is a, c, g, or t/u
  misc_feature (787)..(787): n is a, c, g, or t/u
  misc_feature (790)..(790): n is a, c, g, or t/u
  misc_feature (811)..(811): n is a, c, g, or t/u
  misc_feature (832)..(832): n is a, c, g, or t/u
gattttgagttaagtttaatggcagttgtttgacactctgaagttgctcattcatgttgtttcttggggagagggagctggacaggcaaattttgctccttggacttttagagtatgttacatattggctccaatgatttgcttctcatctggatatcccatatgtctttttgaagtctcttgctctcattctcgaatccctccttgagaaggcgttcctgttcctgaagtttaagagcgagggtcttctcttgctctgccattaactgggccctgtccctctccatcttctcagtcaattgnttcacatgttcctgataactcttctctttctgnccatcatctcctcattcttcttttgtatttcctccaacattttctttgcagcttctgcagattcagcctttatacgttccacttcaatcgctttttccttttctgagagtgactgatcaagtctgtagaagtgcatcagccacatcctccttggactccaaatattttttcagcacctctttggcctgtatccccttcttggccctggtagacttattcttcagctcctgcagcttctgagtaaaaaaaccggaaccctctgggttaagaaaatgttccctgcttgacatcttcttntnaanggcccaatatatcctggaagtaaagccntgccacaatctgatgagctttggaatctggctacaaaaagnatttcgncttgcttccactgggcccctaatttctctggaacatttgggcccatncttgaaaaagtctttattaanacttnaanggccttttttactggccctgngcagggccacaacttctgganggtttcccggggg

SEQ ID NO: 125 - DNA, 818 bp, Homo sapiens
  misc_feature (682)..(682): n is a, c, g, or t/u
  misc_feature (727)..(727): n is a, c, g, or t/u
ctcctaagaagtaccttgctcacctagagcagctaaaggaggaagagctgaaccctgatttcatagaacaagttgcagaattttgttcctacatcctcagccattccaatgtcaagactctttcaggtggcattccagtcaatgggcctcgtctagagagcctggtgctgacctacgtcaatgccatcagcagtggggatctaccctgcatggagaacgcagtcctggccttggcccagatagagaactcagccgcagtggaaaaggctattgcccactatgaacagcagatgggccagaaggtgcagctgcccacggaaaccctccaggagctgctggacctgcacagggacagtgagagagaggccattgaagtcttcatgaagaactctttcaaggatgtggaccaaatgttccagaggaaattaggggcccagttggaagcaaggcgagatgacttttgtaagcagaattccaaagcatcatcagattgttgcatggctttacttcaggatatatttggccctttagaagaagatgtcaagcagggaacattttctaaaccaggaggttaccgtctctttactcaaaagcttgcaggagctgaagaataagtactaccaggtgcccaaggaaggggatacaggccaaagaggtgctgaaaaaatattttggagtcaangaggatgtggcttgatgcactttctacagactggatcagtcactnttaagaaaaaggaaaaaagcgattggaagtgggaacgtattaaaggctgaattttgcagaaacctggcaaaaaaaatgtttggggggaaat

SEQ ID NO: 126 - DNA, 617 bp, Homo sapiens
  misc_feature (245)..(245): n is a, c, g, or t/u
  misc_feature (400)..(400): n is a, c, g, or t/u
  misc_feature (427)..(427): n is a, c, g, or t/u
  misc_feature (430)..(430): n is a, c, g, or t/u
  misc_feature (458)..(458): n is a, c, g, or t/u
  misc_feature (580)..(580): n is a, c, g, or t/u
  misc_feature (602)..(602): n is a, c, g, or t/u
  misc_feature (605)..(605): n is a, c, g, or t/u
tgggaaccatcaaccagcaggccatggaccaacttcactatgtgacagagctgacagatcgaatcaaggcaaactcctcacctggtaacaattctgtagacgactcagctgactttgtgagcttttttccagcatttgtgtggactctcagagatttcaccctggaactggaagtagatggagaacccatcactgctgatgactacttggagctttcgctaaagctaagaaaaggtactgataanaaaagtaaaagctttaatgatcctcggttgtgcatccgaaagttcttccccaagaggaagtgcttcgtcttcgattggcccgctcctaagaagtaccttgctcacctagagcagctaaaggaggaagagctgaaccctgatttcatagaacaagntgcagaattttgttcctacatcctcanccnttccaatgtcaagactctttcaggtggnattccagcaatgggcctcgtctaaaagagcctggtgctgacctacgtcaatgccatcagcagtggggatctccctgcatgggaaaacgcagtcctggccttggcccacatagaagaactcancccgcagggggaaaaggctatntgnccactatgaaac

SEQ ID NO: 127 - DNA, 888 bp, Homo sapiens
  misc_feature (594)..(594): n is a, c, g, or t/u
  misc_feature (632)..(632): n is a, c, g, or t/u
  misc_feature (664)..(664): n is a, c, g, or t/u
  misc_feature (673)..(673): n is a, c, g, or t/u
  misc_feature (734)..(734): n is a, c, g, or t/u
  misc_feature (740)..(740): n is a, c, g, or t/u
  misc_feature (780)..(780): n is a, c, g, or t/u
  misc_feature (787)..(787): n is a, c, g, or t/u
  misc_feature (806)..(806): n is a, c, g, or t/u
  misc_feature (816)..(816): n is a, c, g, or t/u
  misc_feature (835)..(835): n is a, c, g, or t/u
  misc_feature (861)..(861): n is a, c, g, or t/u
  misc_feature (873)..(873): n is a, c, g, or t/u
  misc_feature (878)..(878): n is a, c, g, or t/u
aatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaaagaataacatcttnttcagccacgtaccccatggacctctcacgagaccctntgagcaacttggactatcttttcagagtccanggattccangttggaatacaaaaacttttccccaaaaaccaccaagaacgaatttgtattctttttatcnaattgnttcttttcaagccaccttttgatcaaaccattggtattcnggccaanggatgtgggagttccttgnccttgatatnggcttgggcttgaacattnttaaaatttcttgtcttgagtttggncccaccaaagtnccaanaattgcccaa

SEQ ID NO: 128 - DNA, 751 bp, Homo sapiens
  misc_feature (695)..(695): n is a, c, g, or t/u
  misc_feature (711)..(711): n is a, c, g, or t/u
  misc_feature (720)..(720): n is a, c, g, or t/u
agtattaccatttattgatgacaaacacttaagttttacttacattccatggggagaaaaattccagcgtaaacaatgaatggaagcagtacttaactcgcagggctaccaggctttccatacggaccacacgcagagcctcagtgcacacacttctgtgtacagtaacacaacatcaaaagcaacacagctgtatacagaaacgtaggtcattcttttcagccctaatggagatgtaattaacagtatcgagcactctggaaaatcactctgcaggtttatatggactacatggagatcatatcctgtagtgtagtgaaagctaagtcctcaagagccatatgtatagatacacaatgttttttaataatctttaaaacagagatcaaagttcatttaagtcctgtttgcattaacaaaaataaaaatgaaataaaaatggaaccaaatgatcatctaaagtttaaaattcctaaattgtccaatttatacaactgtgggagacttattcaaggtttttgaaagtccaggactgtttcaagctgaaccagagggcacacaatttgcatcactggaaactgtcctgggttagtcaatgaaataaaaatgtctaaccacattacacatggatatgatcttttgtcggtttagattatttgataaagtcagtcttcagacaagttttcccaaactgngctatttaactaaganacaattggngaaaattctcaaatggaaaaatttttatata

SEQ ID NO: 129 - DNA, 1885 bp, Homo sapiens
cacaaatcagatctacctgcattttcagcagaggtcgaagaggaaagtgaagctggtaaagaaagtgaagaaactgaaactaaacaaactttgaaagaatttcgatgtcaggtaagtgactgttctcgaattttccaagcaattactggcctaatacaacactacatgaaacttcatgaaatgactcctgaagaaattgaaagtatgactgcttcagtggatgttgggaagtttccatgtgaccaattagagtgtaaatcttcatttactacatatttgaactatgttgttcatctagaggcagaccacgggattggactaagggcaagtaaaacagaagaagatggtgtatacaaatgtgattgtgaaggctgtgaccgtatatatgcaacccggtcgaatctcctccgacacatttttaataagcataatgacaaacataaggctcatttgattcgtccaagaagattaacaccaggccaggaaaatatgtcaagcaaggcaaaccaagaaaaatcaaagtctaaacatcgggggaccaagcacagcagatgtggaaaggaaggaataaaaatgcccaagaccaaacgaaagaaaaaaaataatttagaaaacaagaatgcaaagattgtgcagattgaagaaaataagccttattctctgaaacgtgggaagcatgtatattctataaaggctagaaatgatgccctgtctgagtgtacaagcagatttgtaacccagtatccatgtatgataaagggatgtacttcagttgttacaagtgaaagcaatataattagacattataagtgccataaattatctaaggcatttacatcacaacaccgaaatcttcttattgtattcaaacggtgttgcaactcacaagtaaaggaaacgtctgagcaagaaggtgctaagaatgatgtgaaagattctgacacgtgtgtatcagagagcaatgataattcaagaacaacagctacagtttcacaaaaggaagttgaaaaaaatgaaaaagatgaaatggatgaactaacagaattgtttattacaaaattaataaatgaagatagcacaagtgtagagacccaagctaatacttcttcaaatgtaagtaatgattttcagggaagatacctctgccagtccgaaagacaaaaagccagtaatttgaagaagagttaataaaggaaaaaaatgtctcacaaaataaaaaaaggaaagttgaaaaagctgaaccagcatcagcagctgagttaagtagcgggcgtaaagaagaagaaactgctgttgccattcaaccattgaggagcatcctgcatcttttgactggagctctttttaagccaatgggatttgaagatcatttctgaagtttcttgaggagtctgcagtgaagcagaagaaaaatactgcaaagaccatccgaatactggaaacaaaaaaggatcccattcaaattcaagaaaaaatattgataagactgctgtgactagtggaaatcatgtatgtccttgtaaagaaagcgaaacgtttgtacagtttgccaatccatcacagcttcagtgcagtgataatgtaaaaattgttttagacaagaatcttaaagattgcactgagcttgtcttaaagcaacttcaggaaatgaaacctaccgtcagtctgaaaaaacttgaagtacattcaaatgatccagatatgtctgttatgaaagatatcagtataggtaaagccacaggcagaggtcagtactgataattaatgtagtataaatacatcatttaccattttattttaaataggaagccatcaagcatgctagaattgtgaaactttcattatatttttttgttgttgacatgaattaacctggccaaaaccc

SEQ ID NO: 130 - DNA, 961 bp, Homo sapiens
  misc_feature (636)..(636): n is a, c, g, or t/u
  misc_feature (720)..(720): n is a, c, g, or t/u
  misc_feature (729)..(729): n is a, c, g, or t/u
  misc_feature (810)..(810): n is a, c, g, or t/u
  misc_feature (830)..(830): n is a, c, g, or t/u
  misc_feature (842)..(842): n is a, c, g, or t/u
  misc_feature (902)..(902): n is a, c, g, or t/u
  misc_feature (936)..(936): n is a, c, g, or t/u
  misc_feature (941)..(941): n is a, c, g, or t/u
  misc_feature (952)..(952): n is a, c, g, or t/u
gaaaggaaggaataaaaatgcccaagaccaaacgaaagaaaaaaaataatttagaaaacaagaatgcaaagattgtgcagattgaagaaaataagccttattctctgaaacgtgggaagcatgtatattctataaaggctagaaatgatgccctgtctgagtgtacaagcagatttgtaacccagtatccatgtatgataaagggatgtacttcagttgttacaagtgaaagcaatataattagacattataagtgccataaattatctaaggcatttacatcacaacaccgaaatcttcttattgtattcaaacggtgttgcaactcacaagtaaaggaaacgtctgagcaagaaggtgctaagaatgatgtgaaagattctgacacgtgtgtatcagagagcaatgataattcaagaacaacagctacagtttcacaaaaggaagttgaaaaaaatgaaaaagatgaaatggatgaactaacagaattgtttattacaaaattaataaatgaagatagcacaagtgtagagacccaagctaatacttcttcaaatgtaagtaatgattttcagggaagatacctctgccagtccgaaagacaaaaagccagtaatttgaagaagagttaataanggaaaaaaatgtctcacaaaataaaaaaaggaaagttgaaaaagctgaaccagcatcagcagctgagttaagtagcgtgccgtnaagaaaaanaaactgctgttggcattcaaccattgaggagcattctgcttctttgactggagctcttttaagccaatgggaattgaagtntcttttttgaaatttttgangagtctgcagtngaacccaaaaaaaaatcctgccaaaaacccttccgaatactgggaaacaaaaaaagggtnccctttcaaattcaaaaaaaaaatattggttaanactgnttgggacaaangggaaaaaa

SEQ ID NO: 131 - DNA, 786 bp, Homo sapiens
  misc_feature (461)..(461): n is a, c, g, or t/u
  misc_feature (549)..(549): n is a, c, g, or t/u
  misc_feature (570)..(570): n is a, c, g, or t/u
  misc_feature (584)..(584): n is a, c, g, or t/u
  misc_feature (606)..(606): n is a, c, g, or t/u
  misc_feature (617)..(617): n is a, c, g, or t/u
  misc_feature (622)..(622): n is a, c, g, or t/u
  misc_feature (636)..(636): n is a, c, g, or t/u
  misc_feature (682)..(682): n is a, c, g, or t/u
  misc_feature (687)..(687): n is a, c, g, or t/u
  misc_feature (691)..(691): n is a, c, g, or t/u
  misc_feature (746)..(746): n is a, c, g, or t/u
  misc_feature (755)..(755): n is a, c, g, or t/u
gcttttggccaggttaattcatgtcaacaacaaaaaaatataatgaaagtttcacaattctagcatgcttgatggcttcctatttaaaataaaatggtaaatgatgtatttatactacattaattatcagtactgacctctgcctgtggctttacctatactgatatctttcataacagacatatctggatcatttgaatgtacttcaagttttttcagactgacggtaggtttcatttcctgaagttgctttaagacaagctcagtgcaatctttaagattcttgtctaaaacaatttttacattatcactgcactgaagctgtgatggattggcaaactgtacaaacgtttcgctttctttacaaggacatacatgatttccactagtcacagcagtcttatcaatattttttcttgaatttgaatgggatccttttttgtttccagtattcggatggnctttgcagtatttttcttctgcttcactgcagactcctcaagaaacttcagaaatgatcttcaaatcccattggcttaaaaagagctncagtcaaaaagatgcaagganctcctcaatgggtngaatggcaccagcagtttcttnttctttacccncgctncttaactcagctgntggatgctgggtcaacctttttcaacttttcctttttttattttgngaganattnttttccttattaaccctcttcaaatacctggctttttggctttctgactgggcanaaggttttnttccggaaaatcattccttacatttgaagaa

SEQ ID NO: 132 - DNA, 974 bp, Homo sapiens
  misc_feature (526)..(526): n is a, c, g, or t/u
  misc_feature (640)..(640): n is a, c, g, or t/u
  misc_feature (680)..(680): n is a, c, g, or t/u
  misc_feature (683)..(683): n is a, c, g, or t/u
  misc_feature (699)..(699): n is a, c, g, or t/u
  misc_feature (740)..(740): n is a, c, g, or t/u
  misc_feature (811)..(811): n is a, c, g, or t/u
  misc_feature (813)..(813): n is a, c, g, or t/u
  misc_feature (815)..(815): n is a, c, g, or t/u
  misc_feature (871)..(871): n is a, c, g, or t/u
  misc_feature (880)..(880): n is a, c, g, or t/u
  misc_feature (885)..(885): n is a, c, g, or t/u
  misc_feature (901)..(901): n is a, c, g, or t/u
  misc_feature (916)..(916): n is a, c, g, or t/u
  misc_feature (925)..(925): n is a, c, g, or t/u
  misc_feature (951)..(951): n is a, c, g, or t/u
  misc_feature (965)..(965): n is a, c, g, or t/u
ttcatgaaatgactcctgaagaaattgaaagtatgactgcttcagtggatgttgggaagtttccatgtgaccagttagagtgtaaatcttcatttactacatatttgaactatgttgttcatctagaggcagaccacgggattggactaagggcaagtaaaacagaagaagatggtgtatacaaatgtgattgtgaaggctgtgaccgtatatatgcaacccggtcgaatctcctccgacacatttttaataagcataatgacaaacataaggctcatttgattcgtccaagaagattaacaccaggccaggaaaatatgtcaagcaaggcaaaccaagaaaaatcaaagtctaaacatcgggggaccaagcacagcagatgtggaaaggaaggaataaaaatgcccaagaccaaacgaaagaaaaaaaataatttagaaaacaagaatgcaaagattgtgcagattgaagaaaataagccttattctctgaaacgtgggaagcatgtatattctataaaggctanaaatgatgccctgtctgagtgtacaagcagatttgtaacccaatatccatgtatgataaagggatgtacttcagttgttacaagtgaaagcaatataattagacattataagtnccataaattatctaaggcattacatcacacacccgaaatnttnttattgttttcaaacngggtttgcactccaagtaaaggaaacgtctgaccagaaggngctaaaaatgatgtgaaagattctgaccgtgtgtttcagaaaaccaatgttatttcaagaaccaccagctncngnttcacaaaaaggaagtttgaaaaaaaatgaaaaagatgaaatgggtgacctacccnaattgtttnttccnaatttattaaatgaanaatgccccagtgttnagaccccancttaaactttttcaaatgtaagtatngttttcagggaaanaacctttgc

SEQ ID NO: 133 - DNA, 760 bp, Homo sapiens
  misc_feature (58)..(58): n is a, c, g, or t/u
  misc_feature (60)..(60): n is a, c, g, or t/u
  misc_feature (69)..(69): n is a, c, g, or t/u
  misc_feature (110)..(110): n is a, c, g, or t/u
  misc_feature (114)..(114): n is a, c, g, or t/u
  misc_feature (246)..(246): n is a, c, g, or t/u
  misc_feature (413)..(413): n is a, c, g, or t/u
  misc_feature (494)..(494): n is a, c, g, or t/u
  misc_feature (549)..(549): n is a, c, g, or t/u
  misc_feature (597)..(597): n is a, c, g, or t/u
  misc_feature (642)..(642): n is a, c, g, or t/u
  misc_feature (680)..(680): n is a, c, g, or t/u
  misc_feature (698)..(698): n is a, c, g, or t/u
  misc_feature (742)..(742): n is a, c, g, or t/u
  misc_feature (756)..(756): n is a, c, g, or t/u
cacaaatcagatctacctgcattttcagcagaggtcgaagaggaaagtgaagctggtnangaaagtgangaaactgaaactaaacaaactttgaaagaatttcgatgtcnggtnagtgactgttctcgaattttccaagcaattactggcctaatacaacactacatgaaacttcatgaaatgactcctgaagaaattgaaagtatgactgcttcagtggatgttgggaagtttccatgtgaccanttagagtgtaaatcttcatttactacatatttgaactatgttgttcatctagaggcagaccacgggattggactaagggcaagtaaaacagaagaagatggtgtatacaaatgtgattgtgaaggctgtgaccgtatatatgcaacccggacgaatctcctccgacncatttttaataagcataatgacaaacataaggctcatttgattcgtccaagaagattaacaccaggccaggaaaatatgtnaagcaaggcaaaccaagaaaaatcaaagtctaaacatcgggggaccaagcacagnaaatgtggaaaggaaggaataaaaatgccccgaccaacgaaagaaaanaaataatttagaaaacaagaatgcaaagattgggcaaattggaanaaaataagccttattttctgaaacgtgggaagcatgtntattctattaaggctaanaaatgaagccctgtctgagtgtccaagcagaatttgtaaccccngattcctgtatganaaaa

SEQ ID NO: 134 - DNA, 823 bp, Homo sapiens
  misc_feature (281)..(281): n is a, c, g, or t/u
  misc_feature (483)..(483): n is a, c, g, or t/u
  misc_feature (489)..(489): n is a, c, g, or t/u
  misc_feature (538)..(538): n is a, c, g, or t/u
  misc_feature (557)..(557): n is a, c, g, or t/u
  misc_feature (574)..(574): n is a, c, g, or t/u
  misc_feature (596)..(596): n is a, c, g, or t/u
  misc_feature (599)..(599): n is a, c, g, or t/u
  misc_feature (608)..(608): n is a, c, g, or t/u
  misc_feature (625)..(625): n is a, c, g, or t/u
  misc_feature (629)..(629): n is a, c, g, or t/u
  misc_feature (639)..(639): n is a, c, g, or t/u
  misc_feature (669)..(669): n is a, c, g, or t/u
  misc_feature (671)..(671): n is a, c, g, or t/u
  misc_feature (679)..(679): n is a, c, g, or t/u
  misc_feature (684)..(684): n is a, c, g, or t/u
  misc_feature (755)..(755): n is a, c, g, or t/u
  misc_feature (763)..(763): n is a, c, g, or t/u
  misc_feature (779)..(779): n is a, c, g, or t/u
  misc_feature (787)..(787): n is a, c, g, or t/u
  misc_feature (799)..(799): n is a, c, g, or t/u
ggccaggttaattcatgtcaacaacaaaaaaatataatgaaagtttcacaattctagcatgcttgatggcttcctatttaaaataaaatggtaaatgatgtatttatactacattaattatcagtactgacctctgcctgtggctttacctatactgatatctttcataacagacatatctggatcatttgaatgtacttcaagttttttcagactgacggtaggtttcatttcctgaagttgctttaagacaagctcagtgcaatctttaagattcttgnctaaaacaatttttacattatcactgcactgaagctgtgatggattggcaaactgtcaaacgtttcgctttctttcaaggacatacatgatttccactagtcacagcagtcttatcaatattttttcttgaatttgaatgggatccttttttgtttccagtattcggatggtctttgcagtatttttcttctgcttcactgnagactnctcaagaaacttcagaaatgatcttcaaatcccattgggcttaaaaganctccagtcaaaaagatgcnaggatgctcctcatggnttgaatggcaacagcaagtttnttnttctttacncacgctacttaactcanctgntgatgctggntcaactttttcaactttccttttttatttngngagacatnttttncttttacctctcttcaaatacttgcttttggctttctgacgggagaggtttcttccgaaaacatttcttcnatttgaanaagtttaacttgggcncttcactnggcctttcttcnttattaatttggaaaaaacaatct

SEQ ID NO: 135 - DNA, 714 bp, Homo sapiens
  misc_feature (14)..(14): n is a, c, g, or t/u
  misc_feature (222)..(222): n is a, c, g, or t/u
  misc_feature (261)..(261): n is a, c, g, or t/u
  misc_feature (281)..(281): n is a, c, g, or t/u
  misc_feature (455)..(455): n is a, c, g, or t/u
  misc_feature (461)..(461): n is a, c, g, or t/u
  misc_feature (465)..(465): n is a, c, g, or t/u
  misc_feature (492)..(492): n is a, c, g, or t/u
  misc_feature (559)..(559): n is a, c, g, or t/u
  misc_feature (607)..(607): n is a, c, g, or t/u
  misc_feature (624)..(624): n is a, c, g, or t/u
ggccaggttaattnttgtcaacaacaaaaaaatataatgaaagtttcacaattctagcatgcttgatggcttcctatttaaaataaaatggtaaatgatgtatttatactacattaattatcagtactgacctctgcctgtggctttacctatactgatatctttcataacagacatatctggatcatttgaatgtacttcaagttttttcagactgacggnaggtttcatttcctgaagttgctttaagacaagctcagngcaatctttaagattcttgnctaaaacaatttttacattatcactgcactgaagctgtgatggattggcaaactgtacaaacgtttcgctttctttacaaggacatacatgatttccactagtcacagcagtcttatcaatattttttcttgaatttgaatgggatccttttttgtttccagtattcggatggnctttgncaanatttttcttctgcttcactgcagactnctcaagaaacttcaaaaatgatcttcaaaacccattggcttaaaagagctccagtcaaaagatgcangatgctcctcaatgggtgaatggcacagcagtttcttcttctttaccncacgctacttaactcanctgctgatggctgggtcaactttttcaactttccttttttatttggggagacattttttccttataactctctcaaaaactgcttttggc

SEQ ID NO: 136 - DNA, 2441 bp, Homo sapiens
  misc_feature (1100)..(1100): n is a, c, g, or t/u
  misc_feature (1726)..(1726): n is a, c, g, or t/u
  misc_feature (1802)..(1802): n is a, c, g, or t/u
  misc_feature (1918)..(1918): n is a, c, g, or t/u
  misc_feature (2269)..(2269): n is a, c, g, or t/u
  misc_feature (2277)..(2277): n is a, c, g, or t/u
  misc_feature (2279)..(2279): n is a, c, g, or t/u
  misc_feature (2286)..(2286): n is a, c, g, or t/u
  misc_feature (2292)..(2292): n is a, c, g, or t/u
  misc_feature (2327)..(2327): n is a, c, g, or t/u
  misc_feature (2330)..(2330): n is a, c, g, or t/u
  misc_feature (2430)..(2430): n is a, c, g, or t/u
  misc_feature (2433)..(2433): n is a, c, g, or t/u
taagaatcgttcaattggagcagcagctaaaagccaggtaatttctaatgcaaagaacacagtccaaggatttaaaagattccatggccgagcattctctgatccatttgtggaggcagaaaaatctaaccttgcatatgatattgtgcagttgcctacaggattaacaggtataaaggtgacatatatggaggaagagcgaaattttaccactgagcaagtgactgccatgcttttgtccaaactgaaggagacagccgaaagtgttcttaagaagcctgtagttgactgtgttgtttcggttccttgtttctatactgatgcagaaagacgatcagtgatggatgcaacacagattgctggtcttaattgcttgcgattaatgaatgaaaccactgcagttgctcttgcatatggaatctataagcaggatcttcctgccttagaagagaaaccaagaaatgtagtttttgtagacatgggccactctgcttatcaagtttctgtatgtgcatttaatagaggaaaactgaaagttctggccactgcatttgacacgacattgggaggtagaaaatttgatgaagtgttagtaaatcacttctgtgaagaatttgggaagaaatacaagctagacattaagtccaaaatccgtgcattattacgactctctcaggagtgtgagaaactcaagaaattgatgagtgcaaatgcttcagatctccctttgagcattgaatgttttatgaatgatgttgatgtatctggaactatgaatagaggcaaatttctggagatgtgcaatgatctcttagctagagtggagccaccacttcgtagtgttttggaacaaaccaagttaaagaaagaagatatttatgcagtggagatagttggtggtgctacacgaatccctgcggtaaaagagaagatcagcaaatttttcggtaaagaacttagtacaacattaaatgctgatgaagctgtcactcgaggctgtgcattgcagtgtgccatcttatcgcctgctttcaaagtcagagaattttctatcactgatgtagtaccatatccaatatctctgagatggaattctccanctgaagaagggtcaagtgactgtgaagtcttttccaaaaatcatgctgctcctttctctaaagttcttacattttatagaaaggaacctttcactcttgaggcctactacagctctcctcaggatttgccctatccagatcctgctatagctcagttttcagttcagaaagtcactcctcagtctgatggctccagttcaaaagtgaaagtcaaagttcgagtaaatgtccatggcattttcagtgtgtccagtgcatctttagtggaggttcacaagtctgaggaaaatgaggagccaatggaaacagatcagaatgcaaaggaggaagagaagatgcaagtggaccaggaggaaccacatgttgaagagcaacagcagcagacaccagcagaaaataaggcagagtctgaagaaatggagacctctcaagctggatccaaggataaaaagatggaccaaccccccaagccaagaaggcaaaagtgaagaccagtactgtggacctgccaatcgagaatcagctattatggcagatagacagagagatgctcaacttgtacattgaaaatgagggtaagatgatcatgccggataaactggagaaggagcggaatgatgcttaanaacgcagtggaggaatatgtgtatgaaatgagaagccaagcttaagtgggtgaatataaaaagtttgtgagtgaanattgatcgtaccagtttttactttgaaactggaagatacttgaaaattggttgatgaggatggagaagaccagccaaagcaagtttatgttgataagtgggctgaattaaaaaatntaggtcaacctattaagatacgtttccaggaatttgaagaacgaccaaaaattatttgaagaactagggaaacagatccaccagtatatgaaaataatcagctctttcaaaaacaaggaggaccagtatgatcatttggatgctgctgacatgacaaaggtagaaaaaagcacaaatgaagcaatggagtggatgaataacaagctaaatctgcagaacaagcagagtttgaccatggatccagttgtcaagtcaaaagagattgaagctaaaattaaggagctgacaagtacttgtagccctataatttcaaagcccaaacccaaagtggaacctccaaaagagggccanaaaatgcntnccagaanggcccngtggatggacaaggagacaacccaggcccccaggntgntgagcagggtacagacacagctgtgccttcggattcagacaagaagcttcctgaaatggacattgattgattccaacacttgtttctattaaaacagagnatnataaagct

SEQ ID NO: 137 - DNA, 1026 bp, Homo sapiens
  misc_feature (611)..(611): n is a, c, g, or t/u
  misc_feature (643)..(643): n is a, c, g, or t/u
  misc_feature (745)..(745): n is a, c, g, or t/u
  misc_feature (822)..(822): n is a, c, g, or t/u
  misc_feature (829)..(829): n is a, c, g, or t/u
  misc_feature (883)..(883): n is a, c, g, or t/u
  misc_feature (898)..(898): n is a, c, g, or t/u
  misc_feature (904)..(904): n is a, c, g, or t/u
  misc_feature (928)..(928): n is a, c, g, or t/u
  misc_feature (934)..(934): n is a, c, g, or t/u
  misc_feature (941)..(941): n is a, c, g, or t/u
  misc_feature (960)..(960): n is a, c, g, or t/u
  misc_feature (997)..(997): n is a, c, g, or t/u
  misc_feature (1002)..(1002): n is a, c, g, or t/u
  misc_feature (1008)..(1008): n is a, c, g, or t/u
gtgactgtgaagtcttttccaaaaatcatgctgctcctttctctaaagttcttacattttatagaaaggaacctttcactcttgaggcctactacagctctcctcaggatttgccctatccagatcctgctatagctcagttttcagttcagaaagtcactcctcagtctgatggctccagttcaaaagtgaaagtcaaagttcgagtaaatgtccatggcattttcagtgtgtccagtgcatctttagtggaggttcacaagtctgaggaaaatgaggagccaatggaaacagatcagaatgcaaaggaggaagagaagatgcaagtggaccaggaggaaccacatgttgaagagcaacagcagcagacaccagcagaaaataaggcagagtctgaagaaatggagacctctcaagctggatccaaggataaaaagatggaccaaccccccaagccaagaaggcaaaagtgaagaccagtactgtggacctgccaatcgagaatcagctattatggcagatagacagagagatgctcaacttgtacattgaaaatgagggtaagatgatcatgccggataaactggaaaaggagcggaatgatgcttaanaacgcagtggaggaatatgtgtatgaaatganaagacaagcttagtggtgaatttgaaaaagtttgtgaagtgaagatgatcgtaacagttttacttttgaaactgggaagatactgaaaattggttgtttgangatggagaaaaccaacccaagcaagtttttgttggttaagttggctgaattaaaaaattaggtcaacctattaaaanacctttnccgggaatttgaagaacgccccaaattttttggaagaactttggggaaaccgantccaaccgtttttgnaaaatnatcagcttttttcaaaaccagggnggaccngtttgancatttggatgcctgtgggnattgacaaaggtggaaaaaagccccaatgaacccatnggggngggtgnaataacaaacttaatttg

SEQ ID NO: 138 - DNA, 797 bp, Homo sapiens
  misc_feature (9)..(9): n is a, c, g, or t/u
  misc_feature (12)..(12): n is a, c, g, or t/u
  misc_feature (112)..(112): n is a, c, g, or t/u
  misc_feature (115)..(115): n is a, c, g, or t/u
  misc_feature (150)..(150): n is a, c, g, or t/u
  misc_feature (156)..(156): n is a, c, g, or t/u
  misc_feature (163)..(163): n is a, c, g, or t/u
  misc_feature (165)..(165): n is a, c, g, or t/u
  misc_feature (173)..(173): n is a, c, g, or t/u
  misc_feature (524)..(524): n is a, c, g, or t/u
  misc_feature (640)..(640): n is a, c, g, or t/u
  misc_feature (682)..(682): n is a, c, g, or t/u
  misc_feature (712)..(712): n is a, c, g, or t/u
  misc_feature (777)..(777): n is a, c, g, or t/u
agctttatnatnctctgttttaatagaaacaagtgttggaatcaatcaatgtccatttcaggaagcttcttgtctgaatccgaaggcacagctgtgtctgtaccctgctcancancctgggggcctgggttgtctccttgtccatccacngggccnttctggnangcattttntggccctcttttggaggttccactttgggtttgggctttgaaattatagggctacaagtacttgtcagctccttaattttagcttcaatctcttttgacttgacaactggatccatggtcaaactctgcttgttctgcagatttagcttgttattcatccactccattgcttcatttgtgcttttttctacctttgtcatgtcagcagcatccaaatgatcatactggtcctccttgtttttgaaagagctgattattttcatatactggtggatctgtttccctagttcttcaaataatttttggtcgttcttcaaattcctggaaacgtatcttaataggttgacctanattttttaattcagcccacttatcaacataaacttgctttggctggtcttctccatcctcatcaaccaattttcaagtatcttccagtttcaaagtaaaaactggtacgatcaatnttcactcacaaactttttatattcacccacttaagcttggcntctcatttcatacacataatccctcactgngttcttaacaatcattcccctccttcttcaatttatccggcatgaacaacttaccctcattttcnatgtacaagtgagcatcttt

SEQ ID NO: 139 - DNA, 851 bp, Homo sapiens
  misc_feature (672)..(672): n is a, c, g, or t/u
  misc_feature (681)..(681): n is a, c, g, or t/u
  misc_feature (695)..(695): n is a, c, g, or t/u
  misc_feature (722)..(722): n is a, c, g, or t/u
  misc_feature (725)..(725): n is a, c, g, or t/u
  misc_feature (727)..(727): n is a, c, g, or t/u
  misc_feature (734)..(734): n is a, c, g, or t/u
  misc_feature (746)..(746): n is a, c, g, or t/u
  misc_feature (772)..(772): n is a, c, g, or t/u
  misc_feature (785)..(785): n is a, c, g, or t/u
  misc_feature (788)..(788): n is a, c, g, or t/u
  misc_feature (792)..(792): n is a, c, g, or t/u
  misc_feature (803)..(803): n is a, c, g, or t/u
  misc_feature (814)..(814): n is a, c, g, or t/u
  misc_feature (820)..(820): n is a, c, g, or t/u
  misc_feature (829)..(829): n is a, c, g, or t/u
  misc_feature (836)..(836): n is a, c, g, or t/u
  misc_feature (840)..(840): n is a, c, g, or t/u
gttgtttcggttccttgtttctatactgatgcagaaagacgatcagtgatggatgcaacacagattgctggtcttaattgcttgcgattaatgaatgaaaccactgcagttgctcttgcatatggaatctataagcaggatcttcctgccttagaagagaaaccaagaaatgtagtttttgtagacatgggccactctgcttatcaagtttctgtatgtgcatttaatagaggaaaactgaaagttctggccactgcatttgacacgacattgggaggtagaaaatttgatgaagtgttagtaaatcacttctgtgaagaatttgggaagaaatacaagctagacattaagtccaaaatccgtgcattattacgactctctcaggagtgtgagaaactcaagaaattgatgagtgcaaatgcttcagatctccctttgagcattgaatgttttatgaatgatgttgatgtatctggaactatgaatagaggcaaatttctggagatgtgcaatgatctcttagctagagtggagccaccacttcgtagtgttttggaacaaaccaagttaaagaaagaagatatttatgcagtggagatagttggtggtgctacacgaatccctgcggtaaaagagaagatcagccaaatttttcggtaaaagaacttagtnccaacattnaatgctgattgaanctgtcctccaaggctgggccattgcangtngngcccatnttatcccccttnctttcaaaggtcagaagaaattttcntatcacttggtgnagnaccnttattccaatnttttttggaangggaantcttccccncttgaanaaanggtcaaaggga

SEQ ID NO: 140 - DNA, 915 bp, Homo sapiens
  misc_feature (668)..(668): n is a, c, g, or t/u
  misc_feature (680)..(681): n is a, c, g, or t/u
  misc_feature (719)..(719): n is a, c, g, or t/u
  misc_feature (725)..(725): n is a, c, g, or t/u
  misc_feature (809)..(809): n is a, c, g, or t/u
  misc_feature (842)..(842): n is a, c, g, or t/u
  misc_feature (845)..(845): n is a, c, g, or t/u
  misc_feature (847)..(848): n is a, c, g, or t/u
  misc_feature (851)..(851): n is a, c, g, or t/u
  misc_feature (876)..(876): n is a, c, g, or t/u
  misc_feature (885)..(885): n is a, c, g, or t/u
  misc_feature (887)..(887): n is a, c, g, or t/u
  misc_feature (901)..(901): n is a, c, g, or t/u
taagaatcgttcaattggagcagcagctaaaagccaggtaatttctaatgcaaagaacacagtccaaggatttaaaagattccatggccgagcattctctgatccatttgtggaggcagaaaaatctaaccttgcatatgatattgtgcagttgcctacaggattaacaggtataaaggtgacatatatggaggaagagcgaaattttaccactgagcaagtgactgccatgcttttgtccaaactgaaggagacagccgaaagtgttcttaagaagcctgtagttgactgtgttgtttcggttccttgtttctatactgatgcagaaagacgatcagtgatggatgcaacacagattgctggtcttaattgcttgcgattaatgaatgaaaccactgcagttgctcttgcatatggaatctataagcaggatcttcctgccttagaagagaaaccaagaaatgtagtttttgtagacatgggccactctgcttatcaagtttctgtatgtgcatttaatagaggaaaactgaaagtttctggccactgcatttgacacgacattgggaggtagaaaatttgatgaagtgttagtaaatcacttctgtgaaagaatttggggaagaaatcaaagctagaccatttaagtcccaaaaatccgtgcattnttaccgactctnntcagggagtgtggagaaaactcaagaaatttggatgangtgccnaatgcctttcagatcttcctttggagccattgaatgttttattgaaatgatggttgatgtattttgggaacttttgaatttganggcaaaattttcttggggaatgtggccaatgantcntnnttnaccttagaggggggggccccccccnttccctagngngttttggggacccnaacccacttttaag

SEQ ID NO: 141 - DNA, 876 bp, Homo sapiens
  misc_feature (709)..(709): n is a, c, g, or t/u
  misc_feature (712)..(712): n is a, c, g, or t/u
  misc_feature (720)..(720): n is a, c, g, or t/u
  misc_feature (780)..(780): n is a, c, g, or t/u
  misc_feature (795)..(795): n is a, c, g, or t/u
  misc_feature (802)..(802): n is a, c, g, or t/u
  misc_feature (813)..(813): n is a, c, g, or t/u
  misc_feature (831)..(831): n is a, c, g, or t/u
  misc_feature (839)..(839): n is a, c, g, or t/u
  misc_feature (852)..(852): n is a, c, g, or t/u
  misc_feature (856)..(856): n is a, c, g, or t/u
attccatggccgagcattctctgatccatttgtggaggcagaaaaatctaaccttgcatatgatattgtgcagttgcctacaggattaacaggtataaaggtgacatatatggaggaagagcgaaattttaccactgagcaagtgactgccatgcttttgtccaaactgaaggagacagccgaaagtgttcttaagaagcctgtagttgactgtgttgtttcggttccttgtttctatactgatgcagaaagacgatcagtgatggatgcaacacagattgctggttttaattgcttgcgattaatgaatgaaaccactgcagttgctcttgcatatggaatctataagcaggatcttcctgccttagaagagaaaccaagaaatgtagtttttgtagacatgggccactctgcttatcaagtttctgtatgtgcatttaatagaggaaaactgaaagttctggccactgcatttgacacgacattgggaggtagaaaatttgatgaagtgttagtaaatcacttctgtgaagaatttgggaagaaatacaagctagacattaagtccaaaatccgtgcattattacgactctctcaggagtgtgagaaactcaagaaaattgatgaagtgcaaatgcttcagatctcccttttgagcattgaatggtttatgaatgatgttgatgtatcttggaactatgaaatagangcnaatttctnggagaaggtgccaatgatctcttaacctaaagtgggaccccccctttcgtagtggttttnggaaccaaaccaagnttaaagnaaagaagaatntttatgccgtgggaaaanaagttggngggggctacaccnaatnccctgggggtaaaaagaaaa

SEQ ID NO: 142 - DNA, 531 bp, Homo sapiens
  misc_feature (440)..(440): n is a, c, g, or t/u
attacgactctctcaggagtgtgagaaactcaagaaattgatgagtgcaaatgcttcagatctccctttgagcattgaatgttttatgaatgatgttgatgtatctggaactatgaatagaggcaaatttctggagatgtgcaatgatctcttagctagagtggagccaccacttcgtagtgttttggaacaaaccaagttaaagaaagaagatatttatgcagtggagatagttggtggtgctacacgaatccctgcggtaaaagagaagatcagcaaatttttcggtaaagaacttagtacaacattaaatgctgatgaagctgtcactcgaggctgtgcattgcagtgtgccatcttatcgcctgctttcaaagtcagagaattttctatcactgatgtagtaccatatccaatatctctgagatggaattctccanctgaagaagggtcaagtgactgtgaagtctttttcaaaaatcatgctgctcctttctctaaagttcttacattttatagaaaggaaccctt

SEQ ID NO: 143 - DNA, 718 bp, Homo sapiens
  misc_feature (656)..(656): n is a, c, g, or t/u
  misc_feature (692)..(692): n is a, c, g, or t/u
agaagatgcatttaaaatatgggttattttcaactttttatctgaggacaagtatccattaattattgtgtcagaagagattgaatacctgcttaagaagcttacagaagctatgggaggaggttggcagcaagaacaatttgaacattataaaatcaactttgatgacagtaaaaatggcctttctgcatgggaacttattgagcttattggaaatggacagtttagcaaaggcatggaccggcagactgtgtctatggcaattaatgaagtctttaatgaacttatattagatgtgttaaagcagggttacatgatgaaaaagggccacagacggaaaaactggactgaaagatggtttgtactaaaacccaacataatttcttactatgtgagtgaggatctgaaggataagaaaggagacattctcttggatgaaaattgctgtgtagagtccttgcctgacaaagatggaaagaaatgcctttttctcgtaaaatgttttgataagacttttgaaatcagtgctttcagataagaagaagaaacaggagtggattcaagccattcattctactattcatctgttgaagctgggcagccctccaccacacaaagaaacccgccacgtcggaaagaactccggaagaaagcanctggctgaaccaagaaggaactgggaccacaaatgnaaggaactttcaggccgccaaccaaa

SEQ ID NO: 144 - DNA, 537 bp, Homo sapiens
  misc_feature (321)..(321): n is a, c, g, or t/u
  misc_feature (389)..(389): n is a, c, g, or t/u
  misc_feature (468)..(468): n is a, c, g, or t/u
  misc_feature (498)..(498): n is a, c, g, or t/u
  misc_feature (502)..(502): n is a, c, g, or t/u
gttttgttttgagatggagtctcactctgttgcccaagctggagtacaacggcataatctcagctcgctgcaacctccgcctcccacgttcaagtgattctcctgcctcagcctcccaagtagctgggattacaggcgcccgccaccaagctcagctaattttttttgtatttttagtagagacagggtttcaccaggttggccaggctggtcttgaactcctgacctcaggtgatccacccgcctcggcctcccaaagtgctgggattacaggcgtgagccaccacgcccggcccccaaagctgtttcttttgtctttancgtaaagctctcctgccatgcagtatctacataactgacgtgactgccagcaagctcagtcactccgnggtctttttctctttccagatcttctttctctcttcaaagttctgcctcaatggaaagcttgcaggtcccccagttagngatcaggtgaggggtctttgaacctggttntatnaggtcgaattaatccttatgatgggccactttttg

SEQ ID NO: 145 - DNA, 432 bp, Homo sapiens
atgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacaccct

SEQ ID NO: 146 - DNA, 768 bp, Homo sapiens
  misc_feature (431)..(431): n is a, c, g, or t/u
  misc_feature (545)..(545): n is a, c, g, or t/u
  misc_feature (640)..(641): n is a, c, g, or t/u
  misc_feature (710)..(710): n is a, c, g, or t/u
  misc_feature (730)..(730): n is a, c, g, or t/u
  misc_feature (743)..(743): n is a, c, g, or t/u
  misc_feature (761)..(761): n is a, c, g, or t/u
gtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaatnaagatggaggaggagaggaatataataccaagagaagaaaagcctattgaggatgaaattgaaagaaaagaaaatattaagccctctctgggaagtaaaaagaatttattagantctatacctacacattctgatcaggaaaaagaagttaacattaaaaaaaccagaagacaatgaaaatctggatgaccaaagatgatgaccaactnngggtagatgaaatccctcaacataaaagggtagaaagctggaggaaagaaaaagccaaaatctgggttncgatgaatgggtttaaagcncgattaaaatagntaaggaccctgcttgatnaaaaatg

SEQ ID NO: 147 - DNA, 921 bp, Homo sapiens
  misc_feature (321)..(321): n is a, c, g, or t/u
  misc_feature (469)..(469): n is a, c, g, or t/u
  misc_feature (472)..(472): n is a, c, g, or t/u
  misc_feature (510)..(510): n is a, c, g, or t/u
  misc_feature (537)..(537): n is a, c, g, or t/u
  misc_feature (564)..(564): n is a, c, g, or t/u
  misc_feature (571)..(571): n is a, c, g, or t/u
  misc_feature (582)..(582): n is a, c, g, or t/u
  misc_feature (602)..(602): n is a, c, g, or t/u
  misc_feature (619)..(619): n is a, c, g, or t/u
  misc_feature (644)..(644): n is a, c, g, or t/u
  misc_feature (655)..(655): n is a, c, g, or t/u
  misc_feature (681)..(681): n is a, c, g, or t/u
  misc_feature (696)..(696): n is a, c, g, or t/u
  misc_feature (722)..(722): n is a, c, g, or t/u
  misc_feature (727)..(727): n is a, c, g, or t/u
  misc_feature (741)..(741): n is a, c, g, or t/u
  misc_feature (743)..(743): n is a, c, g, or t/u
  misc_feature (749)..(750): n is a, c, g, or t/u
  misc_feature (754)..(754): n is a, c, g, or t/u
  misc_feature (760)..(760): n is a, c, g, or t/u
  misc_feature (762)..(762): n is a, c, g, or t/u
  misc_feature (764)..(764): n is a, c, g, or t/u
  misc_feature (797)..(798): n is a, c, g, or t/u
  misc_feature (806)..(806): n is a, c, g, or t/u
  misc_feature (811)..(811): n is a, c, g, or t/u
  misc_feature (817)..(817): n is a, c, g, or t/u
  misc_feature (822)..(822): n is a, c, g, or t/u
  misc_feature (826)..(826): n is a, c, g, or t/u
  misc_feature (838)..(838): n is a, c, g, or t/u
  misc_feature (855)..(855): n is a, c, g, or t/u
  misc_feature (868)..(868): n is a, c, g, or t/u
  misc_feature (874)..(874): n is a, c, g, or t/u
  misc_feature (882)..(882): n is a, c, g, or t/u
  misc_feature (889)..(889): n is a, c, g, or t/u
  misc_feature (907)..(907): n is a, c, g, or t/u
  misc_feature (915)..(915): n is a, c, g, or t/u
gttgtttaccactgttgctttatggcttcttttctgcttttttgatgaacttcctcctccctgagcatctttcactcttttctgacctgtacaggctttttcaggatgttctggttctggctgattactactgcttgagctcacactggcatcaaaacctgctggcgagctattcccttcagactggaggtcttggagctccccagcaacactatccacctcaattgtgctatcagtttcactcttgatacttcgaacctcttcttggtttggagccagtggttctgatactgttacagaagactgctgccggctgccttntgttacagtgactgatgaaggcgattcaggtgtagtaggaggggtatttaagcactgaattactgccactacttggaaattctgcttttctgcattgacctctactggtttttcttcaatgggtttactatcgacattgactggaggnggnttttctagttctacactgggtgaacaactctcctcttnaaccacagtctgcagtgactcctctgncccccctcctttggggcaagatgcggnggggaanctgcaccctantatcaaaatctgaaaaaacnctttcaacggtttttangcccctgtcctgaatacttgaccanacaatcttttngaaccttggccctgctgttttgaagntttcatcaaaagttntttaaaaggtaatcctttttttggcncttcntgaaaatcctgaananaaaccnnttgntccganananttttttttttctccaaaccattggattcttaanngggggcanctcgntttggntcttntcanctcatctgaaanctggggtcctggtttcnagccaaaggaaanttggtnttggcctncttttcntttttgccagggacccanttttaaancctttt

SEQ ID NO: 148 - DNA, 805 bp, Homo sapiens
  misc_feature (675)..(675): n is a, c, g, or t/u
  misc_feature (720)..(720): n is a, c, g, or t/u
  misc_feature (745)..(746): n is a, c, g, or t/u
  misc_feature (760)..(760): n is a, c, g, or t/u
  misc_feature (766)..(766): n is a, c, g, or t/u
  misc_feature (795)..(795): n is a, c, g, or t/u
ctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggacgacaaagatgatgacacaactagggtagatgaatccctcaacataaaggtagaagctgaggaagaaaaagcaaaatctggagatgaaacgaataaagaagaagatgaagatgatgaagaagcagaagaggaggaggaggaggaagaanaaagaagaggatgaagatgatgatgaccaaccaatggaggaagangagtttgagtgctatccaccaggcnntgaaagtccaagtnccggtntggaccaagggaaaaattcaaaaaatgtntgaagcttgt

SEQ ID NO: 149 - DNA, 665 bp, Homo sapiens
  misc_feature (10)..(10): n is a, c, g, or t/u
  misc_feature (113)..(113): n is a, c, g, or t/u
  misc_feature (115)..(116): n is a, c, g, or t/u
  misc_feature (137)..(137): n is a, c, g, or t/u
  misc_feature (164)..(164): n is a, c, g, or t/u
  misc_feature (205)..(205): n is a, c, g, or t/u
  misc_feature (214)..(214): n is a, c, g, or t/u
  misc_feature (251)..(251): n is a, c, g, or t/u
  misc_feature (273)..(273): n is a, c, g, or t/u
  misc_feature (320)..(320): n is a, c, g, or t/u
  misc_feature (325)..(325): n is a, c, g, or t/u
  misc_feature (343)..(343): n is a, c, g, or t/u
  misc_feature (346)..(346): n is a, c, g, or t/u
  misc_feature (357)..(357): n is a, c, g, or t/u
  misc_feature (361)..(361): n is a, c, g, or t/u
  misc_feature (389)..(389): n is a, c, g, or t/u
  misc_feature (391)..(391): n is a, c, g, or t/u
  misc_feature (447)..(447): n is a, c, g, or t/u
  misc_feature (450)..(450): n is a, c, g, or t/u
  misc_feature (458)..(458): n is a, c, g, or t/u
  misc_feature (463)..(463): n is a, c, g, or t/u
  misc_feature (472)..(472): n is a, c, g, or t/u
  misc_feature (488)..(488): n is a, c, g, or t/u
  misc_feature (492)..(492): n is a, c, g, or t/u
  misc_feature (520)..(520): n is a, c, g, or t/u
  misc_feature (533)..(533): n is a, c, g, or t/u
  misc_feature (548)..(548): n is a, c, g, or t/u
  misc_feature (550)..(550): n is a, c, g, or t/u
  misc_feature (591)..(591): n is a, c, g, or t/u
  misc_feature (600)..(600): n is a, c, g, or t/u
  misc_feature (607)..(608): n is a, c, g, or t/u
  misc_feature (653)..(653): n is a, c, g, or t/u
ccgacatcanaatctttaatactagcttcatacattttttgatttttccctcgtccataccgcacttggactttcatgcctgggggatagcactcaaactcctcttcctcatngnnggcatcatcatcttcatcctnttcttcttcttcctcctcctcctcctnttctgcttcttcatcatcttcatcttcttctttattcgttncatctccanattttgctttttcttcctcagcttctacctttatgtngagggattcatctaccctagtngggtcatcatctttggcgcccaaattttcattggcttctggtttttnaatgntaacttctttttcctgancanaatgggtaggnatanattctaataaattctttttacttcccananagggcttaatattttcttttctttcaatttcatcctcaataggcttttcttctctnggnattatatnccccncctcctccntctttatttctttgancccnggtcattttcctccttaacttttatttnttttacattttcncactccttacattgntnggtaacaactttctttggcaatgccatctgaaattcaatgnttggctganctacagnnctcctcaaaaccatataaagttttttttataaagcccatttaacnttggttccctgc

SEQ ID NO: 150 - DNA, 827 bp, Homo sapiens
  misc_feature (721)..(721): n is a, c, g, or t/u
  misc_feature (723)..(723): n is a, c, g, or t/u
  misc_feature (738)..(738): n is a, c, g, or t/u
  misc_feature (764)..(764): n is a, c, g, or t/u
  misc_feature (769)..(769): n is a, c, g, or t/u
  misc_feature (781)..(781): n is a, c, g, or t/u
  misc_feature (787)..(787): n is a, c, g, or t/u
tgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaggaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgagggagtactgtagatcagccaacattgaatttcagatggcattgccagagaaagttgttaacaagcaatgtaagggagtgtgaaaatgtaaaagaaataaaagttaangngggaaaatggaaccngaggatcaaagaaattaaagatgggnggganggagagggaatnttattncccggagaagaaaaagcccttttggagggatgaaaattgg

SEQ ID NO: 151 - DNA, 811 bp, Homo sapiens
  misc_feature (593)..(593): n is a, c, g, or t/u
  misc_feature (714)..(714): n is a, c, g, or t/u
  misc_feature (719)..(719): n is a, c, g, or t/u
  misc_feature (733)..(733): n is a, c, g, or t/u
  misc_feature (740)..(740): n is a, c, g, or t/u
  misc_feature (753)..(753): n is a, c, g, or t/u
  misc_feature (765)..(765): n is a, c, g, or t/u
  misc_feature (784)..(784): n is a, c, g, or t/u
  misc_feature (792)..(792): n is a, c, g, or t/u
  misc_feature (807)..(807): n is a, c, g, or t/u
  misc_feature (809)..(809): n is a, c, g, or t/u
agatgctctttgccccttgctgtcatcagtgtggtgaattcatcattggccgagttatcaaagccatgaataacagctggcatccggagtgcttccgctgtgacctctgccaggaagttctggcagatatcgggtttgtcaagaatgctgggagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcgggaaggagctgactgccgatgcacgggagctgaaaggggagctatactgcctcccatgccatgataaaatgggggtccccatctgtggtgcttgccgacggcccatcgaagggcgcgtggtgaacgctatgggcaagcagtggcatgtggagcattttgtttgtgccaagtgtgagaaaccctttcttggacatcgccattatgagaggaaaggcctggcgtattgtgaaactcactataaccagctatttggtgatgtttgcttccactgcaatcgtgttatagaaggngatgtggtctctgctcttaataaggcctggtgcgtgaactgctttgcctgttctaccttgcaacacttaaattaacactcaagaataagtttggtggagtttgacattgaaacccagtctnttaanaagtgctttttaanaaatttncatttggagcttnaagaaaaagacnttaagaaaacttccttganacccttangaaagggaaataagntncc

SEQ ID NO: 152 - DNA, 739 bp, Homo sapiens; identical to SEQ ID NO: 61
  misc_feature (31)..(31): n is a, c, g, or t/u
  misc_feature (36)..(36): n is a, c, g, or t/u
  misc_feature (71)..(71): n is a, c, g, or t/u
  misc_feature (241)..(241): n is a, c, g, or t/u
  misc_feature (306)..(306): n is a, c, g, or t/u
  misc_feature (375)..(375): n is a, c, g, or t/u
  misc_feature (616)..(616): n is a, c, g, or t/u
  misc_feature (618)..(618): n is a, c, g, or t/u
  misc_feature (675)..(675): n is a, c, g, or t/u
  misc_feature (680)..(680): n is a, c, g, or t/u
  misc_feature (682)..(682): n is a, c, g, or t/u
  misc_feature (688)..(688): n is a, c, g, or t/u
  misc_feature (697)..(697): n is a, c, g, or t/u
  misc_feature (715)..(715): n is a, c, g, or t/u
  misc_feature (723)..(724): n is a, c, g, or t/u

SEQ ID NO: 153 - DNA, 665 bp, Homo sapiens; identical to SEQ ID NO: 62
  misc_feature (458)..(458): n is a, c, g, or t/u
  misc_feature (474)..(474): n is a, c, g, or t/u
  misc_feature (537)..(537): n is a, c, g, or t/u
  misc_feature (589)..(589): n is a, c, g, or t/u
  misc_feature (609)..(609): n is a, c, g, or t/u
  misc_feature (635)..(635): n is a, c, g, or t/u

SEQ ID NO: 154 - DNA, 597 bp, Homo sapiens
  misc_feature (428)..(428): n is a, c, g, or t/u
  misc_feature (508)..(508): n is a, c, g, or t/u
  misc_feature (518)..(518): n is a, c, g, or t/u
  misc_feature (593)..(593): n is a, c, g, or t/u
gtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacaagtccaaataacggcttatcctaccagcccaatggcctgcctcaccctaccccacctccacctnagcattaccgtttggatgatatggccattgcccaccactacagggactcctatcgacaccccagccacaggggacctcanggacagaaanagacctatggggttgcatggcacacgtcaagaagaaatgattgatcccagactaacagactgagaatgggcctgnaaga

SEQ ID NO: 155 - DNA, 1003 bp, Homo sapiens; identical to SEQ ID NO: 63
  misc_feature (548)..(548): n is a, c, g, or t/u
  misc_feature (590)..(590): n is a, c, g, or t/u
  misc_feature (614)..(614): n is a, c, g, or t/u
  misc_feature (633)..(633): n is a, c, g, or t/u
  misc_feature (639)..(639): n is a, c, g, or t/u
  misc_feature (648)..(648): n is a, c, g, or t/u
  misc_feature (658)..(658): n is a, c, g, or t/u
  misc_feature (687)..(687): n is a, c, g, or t/u
  misc_feature (707)..(707): n is a, c, g, or t/u
  misc_feature (710)..(710): n is a, c, g, or t/u
  misc_feature (712)..(712): n is a, c, g, or t/u
  misc_feature (730)..(730): n is a, c, g, or t/u
  misc_feature (735)..(735): n is a, c, g, or t/u
  misc_feature (771)..(771): n is a, c, g, or t/u
  misc_feature (805)..(805): n is a, c, g, or t/u
  misc_feature (813)..(813): n is a, c, g, or t/u
  misc_feature (824)..(824): n is a, c, g, or t/u
  misc_feature (851)..(851): n is a, c, g, or t/u
  misc_feature (862)..(862): n is a, c, g, or t/u
  misc_feature (882)..(882): n is a, c, g, or t/u
  misc_feature (900)..(900): n is a, c, g, or t/u
  misc_feature (913)..(913): n is a, c, g, or t/u
  misc_feature (919)..(919): n is a, c, g, or t/u
  misc_feature (927)..(927): n is a, c, g, or t/u
  misc_feature (929)..(929): n is a, c, g, or t/u
  misc_feature (933)..(933): n is a, c, g, or t/u
  misc_feature (940)..(940): n is a, c, g, or t/u
  misc_feature (977)..(977): n is a, c, g, or t/u
  misc_feature (1000)..(1000): n is a, c, g, or t/u

SEQ ID NO: 156 - DNA, 674 bp, Homo sapiens
  misc_feature (631)..(631): n is a, c, g, or t/u
  misc_feature (655)..(655): n is a, c, g, or t/u
gtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatggggcagaagagtggaaacatcttgaccatctgttaaactgcataatnggacatggtagaaaaaacaaaggngatctcttaccgtacttaa

SEQ ID NO: 157 - DNA, 651 bp, Homo sapiens
  misc_feature (588)..(588): n is a, c, g, or t/u
  misc_feature (617)..(617): n is a, c, g, or t/u
  misc_feature (631)..(631): n is a, c, g, or t/u
ccattattgtatataaagaacattgtgacttttaatattagcatttttgctttcaacagcaattagcaatctcttggtttgctgtttggtaaagcatcggttaatgaggtcatctagtttaaaatcccagctacttgaaaataacagggaggaggtcaaatctatcatttcatgttatattctctgctctcttttcagttctctaaagaaaagatatctttgttatccacaataagtcattacgacccgttactggccctctgtgttttactaccacctcaagatacagttaggttctctcttgctgaagtactgaaataggataattcatctaataaacaaacaaacaaaaaaaacaactttgagcatctgaggatgaggaattggtttcgcgttggttgtgttgtctttcctccgacagttctgagttcacgtctagcgaggggttgtctctatggtggaaggggttcccggggtggttgacctcggagtggctgctggtggtgtgtccatcgggctcccagccccgctgttgggcgtgacaaaagagctgactgcaggggtgtctccctgctgctgggcctgcanggtctgtccacaaatgtggatggggcttntccccagcttttgngctgggcaaatgagcccagt

SEQ ID NO: 158 - DNA, 803 bp, Homo sapiens
caatgatgctacctgttctgacccatcatatccgctaccaccaatgcctaatgcatttggacaagttgataggatatactttccaagatcgttgtctgttgcagctggccatgactcatccaagtcatcatttaaattttggaatgaatcctgatcatgccaggaattcattatctaactgtggaattcggcagcccaaatacggagacagaaaagttcatcacatgcacatgcggaagaaagggattaacaccttgataaatatcatgtcacgccttggccaagatgacccaactccctcgaggattaaccacaatgaacggttggaattcctgggtgatgctgttgttgaatttctgaccagcgtccatttgtactatttgtttcctagtctggaagaaggaggattagcaacctatcggactgccattgttcagaatcagcaccttgccatgctagcaaagaaacttgaactggatcgatttatgctgtatgctcacgggcctgacctttgtagagaatcggaccttcgacatgcaatggccaattgttttgaagcgttaataggagctgtttacttggagggaagcctggaggaagccaagcagttatttggacgcttgctctttaatgatccggacctgcgcgaagtctggctcaattatcctcttcacccactccaactacaagagccaaatactgatcgacaacttattggaaactttttccagttctacaaaaaacttactgagtttgaaagaaaccaattgggagtaaattttttactcattggttccgacttt

SEQ ID NO: 159 - DNA, 701 bp, Homo sapiens
  misc_feature (513)..(513): n is a, c, g, or t/u
  misc_feature (552)..(552): n is a, c, g, or t/u
  misc_feature (569)..(569): n is a, c, g, or t/u
  misc_feature (599)..(599): n is a, c, g, or t/u
  misc_feature (602)..(602): n is a, c, g, or t/u
  misc_feature (606)..(606): n is a, c, g, or t/u
  misc_feature (655)..(655): n is a, c, g, or t/u
gcgatttgactctgtattttatttcaatgagcacacttcgttcattgtctgcaggaaaactaggctaggtctcaatagacaacagtcacagttactgagcaagtaaatactccacacttgcatgccctcctttatttcttgatgtcttcagtctcatctggctctctctcttgatgctctctttcccacctcatttcttttaactcttgtctgtacttccgttcgatgaaccgcttctgatgggccatctggggaaaattatatttttcaagcgcatccattgctgctcccatttccgcttgctgaatacttggtcctttcccacagcctattctttctcccttgaaataaacagccacagtgtaggttcgggcatgggatgggcccactgtctgcagagtcttgtacaaaggaatgtctggctcttttccttctgcctaagggcaagcaacactgctgaagctgggatttggggcattccaatcctgattcaaaatgaactcttttaatcgnggaaagaaacagacattcatgaaaagtatgaacatattncaaatccttatcaatgnacagcgctgcaataaatgattccaaaaggnccnccanggcttggggcgaaacccccaaggccttttggcttggcgtgggtattggnggactcctggatgcccaagttcttccgtaccttgggcctgggtttt

SEQ ID NO: 160 - DNA, 833 bp, Homo sapiens
ggattaacaccttgataaatatcatgtcacgccttggccaagatgacccaactccctcgaggattaaccacaatgaacggttggaattcctgggtgatgctgttgttgaatttctgaccagcgtccatttgtactatttgtttcctagtctggaagaaggaggattagcaacctatcggactgccattgttcagaatcagcaccttgccatgctagcaaagaaacttgaactggatcgatttatgctgtatgctcacgggcctgacctttgtagagaatcggaccttcgacatgcaatggccaattgttttgaagcgttaataggagctgtttacttggagggaagcctggaggaagccaagcagttatttggacgcttgctctttaatgatccggacctgcgcgaagtctggctcaattatcctctccacccactccaactacaagagccaaatactgatcgacaacttattgaaacttctccagttctacaaaaacttactgagtttgaagaagcaattggagtaatttttactcatgttcgacttctggcaagggcattcacattgagaactgtgggatttaaccatctgaccctaggccacaatcagagaatggaattcctaggtgactccataatgcaactggtaccacagagtacttattcattcatttcccagatcatcattgaaggacacttaacttttgttgcgaaagcttctttgggtgaaattaataagaacttcaggcccaaaggtaaccggaaggaagcttgggcattgcagggaagtacccccattacccaaccggaccaagaacccaagaaggcctgt

SEQ ID NO: 161 - DNA, 566 bp, Homo sapiens; identical to SEQ ID NO: 65
  misc_feature (36)..(37): n is a, c, g, or t/u
  misc_feature (39)..(39): n is a, c, g, or t/u
  misc_feature (42)..(42): n is a, c, g, or t/u
  misc_feature (44)..(44): n is a, c, g, or t/u
  misc_feature (48)..(48): n is a, c, g, or t/u
  misc_feature (50)..(51): n is a, c, g, or t/u
  misc_feature (55)..(55): n is a, c, g, or t/u
  misc_feature (60)..(60): n is a, c, g, or t/u
  misc_feature (292)..(292): n is a, c, g, or t/u
  misc_feature (339)..(339): n is a, c, g, or t/u
  misc_feature (506)..(506): n is a, c, g, or t/u
  misc_feature (529)..(529): n is a, c, g, or t/u
  misc_feature (544)..(544): n is a, c, g, or t/u
  misc_feature (546)..(546): n is a, c, g, or t/u
  misc_feature (561)..(561): n is a, c, g, or t/u

SEQ ID NO: 162 - DNA, 445 bp, Homo sapiens; identical to SEQ ID NO: 66
  misc_feature (3)..(3): n is a, c, g, or t/u
  misc_feature (15)..(15): n is a, c, g, or t/u
  misc_feature (33)..(33): n is a, c, g, or t/u
  misc_feature (36)..(36): n is a, c, g, or t/u
  misc_feature (40)..(40): n is a, c, g, or t/u
  misc_feature (45)..(45): n is a, c, g, or t/u
  misc_feature (52)..(52): n is a, c, g, or t/u
  misc_feature (96)..(96): n is a, c, g, or t/u
  misc_feature (112)..(112): n is a, c, g, or t/u
  misc_feature (116)..(116): n is a, c, g, or t/u
  misc_feature (158)..(158): n is a, c, g, or t/u
  misc_feature (212)..(212): n is a, c, g, or t/u
  misc_feature (214)..(214): n is a, c, g, or t/u
  misc_feature (240)..(240): n is a, c, g, or t/u
  misc_feature (258)..(258): n is a, c, g, or t/u
  misc_feature (308)..(308): n is a, c, g, or t/u
  misc_feature (312)..(312): n is a, c, g, or t/u
  misc_feature (370)..(370): n is a, c, g, or t/u
  misc_feature (387)..(387): n is a, c, g, or t/u

SEQ ID NO: 163 - DNA, 765 bp, Homo sapiens
  misc_feature (556)..(556): n is a, c, g, or t/u
  misc_feature (579)..(579): n is a, c, g, or t/u
  misc_feature (641)..(641): n is a, c, g, or t/u
  misc_feature (653)..(653): n is a, c, g, or t/u
  misc_feature (661)..(661): n is a, c, g, or t/u
  misc_feature (666)..(666): n is a, c, g, or t/u
  misc_feature (672)..(672): n is a, c, g, or t/u
  misc_feature (687)..(687): n is a, c, g, or t/u
  misc_feature (706)..(706): n is a, c, g, or t/u
  misc_feature (749)..(749): n is a, c, g, or t/u
gagtttgcaaaggaattttggaatatcttacagtggcagaggtggtggagactatggaagatttggtcacttacacaaagaatcttgggccaggaatgactaagatggccaagatgattgacgagagacagcaggagctcactcaccaggagcaccgagtgatgttggtgaactcgatgaacaccgtgaaagagttgctgccagttctcatttcagctatgaagatttttgtaacaactaaaaactcaaaaaaccaaggcatagaggaagctttaaaaaatcgcaattttactgtagaaaaaatgagtgctgaaattaatgagataattcgtgtgttacaactcacctcttgggatgaagatgcctgggccagcaaggacactgaagccatgaagagagcattggcctccatagactccaaactgaaccaggccaaaggttggctccgtgaccctagtgcctccccaggggatgctggtgagcaggccatcagacagatcttagatgaagctggaaaagttggtgaactctgtgcaggcaaaaaacgcagggagantctggggaacttgcaaaatgctngggcagatgactgtcaaagtggcttgacctccgtgccaagaggacaaggatccttacccggngggccatgccanaaaagctnaacanggtatnttcaaggtcttggantgtgctccccagcaaaagnggaaaaagccagcttccaaagctgggaaagccttgcccacttnaaaccaaaacatttgc

SEQ ID NO: 164 - DNA, 487 bp, Homo sapiens; identical to SEQ ID NO: 68
  misc_feature (470)..(470): n is a, c, g, or t/u

SEQ ID NO: 165 - DNA, 826 bp, Homo sapiens; identical to SEQ ID NO: 69
  misc_feature (651)..(651): n is a, c, g, or t/u
  misc_feature (719)..(719): n is a, c, g, or t/u
  misc_feature (780)..(780): n is a, c, g, or t/u
  misc_feature (783)..(783): n is a, c, g, or t/u
  misc_feature (791)..(791): n is a, c, g, or t/u
  misc_feature (817)..(817): n is a, c, g, or t/u
  misc_feature (820)..(820): n is a, c, g, or t/u

SEQ ID NO: 166 - DNA, 600 bp, Homo sapiens
  misc_feature (4)..(4): n is a, c, g, or t/u
  misc_feature (39)..(39): n is a, c, g, or t/u
  misc_feature (55)..(56): n is a, c, g, or t/u
  misc_feature (60)..(60): n is a, c, g, or t/u
  misc_feature (69)..(69): n is a, c, g, or t/u
  misc_feature (71)..(71): n is a, c, g, or t/u
  misc_feature (74)..(74): n is a, c, g, or t/u
  misc_feature (94)..(94): n is a, c, g, or t/u
  misc_feature (109)..(109): n is a, c, g, or t/u
  misc_feature (117)..(117): n is a, c, g, or t/u
  misc_feature (120)..(120): n is a, c, g, or t/u
  misc_feature (133)..(133): n is a, c, g, or t/u
  misc_feature (140)..(140): n is a, c, g, or t/u
  misc_feature (142)..(143): n is a, c, g, or t/u
  misc_feature (145)..(145): n is a, c, g, or t/u
  misc_feature (170)..(170): n is a, c, g, or t/u
  misc_feature (175)..(175): n is a, c, g, or t/u
  misc_feature (181)..(181): n is a, c, g, or t/u
  misc_feature (186)..(186): n is a, c, g, or t/u
  misc_feature (189)..(189): n is a, c, g, or t/u
  misc_feature (191)..(191): n is a, c, g, or t/u
  misc_feature (193)..(193): n is a, c, g, or t/u
  misc_feature (201)..(201): n is a, c, g, or t/u
  misc_feature (211)..(211): n is a, c, g, or t/u
  misc_feature (213)..(213): n is a, c, g, or t/u
  misc_feature (225)..(226): n is a, c, g, or t/u
  misc_feature (230)..(230): n is a, c, g, or t/u
  misc_feature (236)..(236): n is a, c, g, or t/u
  misc_feature (249)..(249): n is a, c, g, or t/u
  misc_feature (252)..(252): n is a, c, g, or t/u
  misc_feature (254)..(254): n is a, c, g, or t/u
  misc_feature (256)..(256): n is a, c, g, or t/u
  misc_feature (274)..(274): n is a, c, g, or t/u
  misc_feature (286)..(287): n is a, c, g, or t/u
  misc_feature (291)..(291): n is a, c, g, or t/u
  misc_feature (298)..(298): n is a, c, g, or t/u
  misc_feature (301)..(301): n is a, c, g, or t/u
  misc_feature (304)..(305): n is a, c, g, or t/u
  misc_feature (317)..(317): n is a, c, g, or t/u
  misc_feature (320)..(320): n is a, c, g, or t/u
  misc_feature (324)..(324): n is a, c, g, or t/u
  misc_feature (326)..(326): n is a, c, g, or t/u
  misc_feature (329)..(329): n is a, c, g, or t/u
  misc_feature (331)..(331): n is a, c, g, or t/u
  misc_feature (338)..(339): n is a, c, g, or t/u
  misc_feature (351)..(351): n is a, c, g, or t/u
  misc_feature (358)..(358): n is a, c, g, or t/u
  misc_feature (371)..(371): n is a, c, g, or t/u
  misc_feature (377)..(377): n is a, c, g, or t/u
  misc_feature (384)..(384): n is a, c, g, or t/u
  misc_feature (390)..(390): n is a, c, g, or t/u
  misc_feature (404)..(404): n is a, c, g, or t/u
  misc_feature (417)..(417): n is a, c, g, or t/u
  misc_feature (429)..(429): n is a, c, g, or t/u
  misc_feature (452)..(452): n is a, c, g, or t/u
  misc_feature (462)..(462): n is a, c, g, or t/u
  misc_feature (471)..(471): n is a, c, g, or t/u
  misc_feature (474)..(474): n is a, c, g, or t/u
  misc_feature (483)..(483): n is a, c, g, or t/u
  misc_feature (501)..(501): n is a, c, g, or t/u
  misc_feature (506)..(506): n is a, c, g, or t/u
  misc_feature (525)..(525): n is a, c, g, or t/u
  misc_feature (548)..(548): n is a, c, g, or t/u
  misc_feature (551)..(551): n is a, c, g, or t/u
  misc_feature (554)..(554): n is a, c, g, or t/u
  misc_feature (556)..(556): n is a, c, g, or t/u
  misc_feature (568)..(568): n is a, c, g, or t/u
  misc_feature (574)..(574): n is a, c, g, or t/u
  misc_feature (599)..(599): n is a, c, g, or t/u
ggcntcattgatttgcatttttacttgatcttggaattnaaaaaaaaatgcttgnnaggnctttaaggncntgnctttaccttcatcctttatnaaggaagctttgccngttttggncanctgttttaacttntcccaancnncnggtttgctggatttccctgcttganctacnctggtnttttnaancngntttctccncttctccttntnttttattttcanncccntttganatttctttttccntcncncncggttcttggctggagcnggtttttcagcnnctgnttttatntcnccnnctttatttttcnccntgancnccncnggggccnngaaagctgcatnactaacnctcactggggctncttccnccatggntatggntgggaaatttgacncaactttaatctntgggcaggcggnttagggataaaggggaagttganagggcctccnattttaaanaanagggaaccntcatcttctgaatttctncatgnccggattttttcttctggnggttttggcgggggagttgaggnacnccngntcaaaaatttcncaaggngcaaatttactctttttatggggcna

SEQ ID NO: 167 - DNA, 354 bp, Homo sapiens
cagattttgtcacgtggggacccagctgtacatatgtggataagctgattaatggttttgcaactgtaatagtagctgtatcgttctaatgcagacattggatttggtgactgtctcattgtgccatgaggtaaatgtaatgtttcaggcattctgcttgcaaaaaaatctatcatgtgcttttctagatgtctctggttctatagtgcaaatgcttttattagccaataggaattttaaaataacatggaacttacacaaaaggcttttcatgtgccttacttttttaaaaaggagtttattgtattcattggaatatgtgacgtaagcaataaagggaatgttagacgtgtt

SEQ ID NO: 168 - DNA, 426 bp, Homo sapiens
  misc_feature (7)..(7): n is a, c, g, or t/u
  misc_feature (33)..(33): n is a, c, g, or t/u
  misc_feature (79)..(79): n is a, c, g, or t/u
  misc_feature (96)..(96): n is a, c, g, or t/u
  misc_feature (127)..(127): n is a, c, g, or t/u
  misc_feature (141)..(141): n is a, c, g, or t/u
  misc_feature (153)..(153): n is a, c, g, or t/u
  misc_feature (158)..(158): n is a, c, g, or t/u
  misc_feature (161)..(161): n is a, c, g, or t/u
  misc_feature (166)..(166): n is a, c, g, or t/u
  misc_feature (169)..(169): n is a, c, g, or t/u
  misc_feature (176)..(176): n is a, c, g, or t/u
  misc_feature (183)..(183): n is a, c, g, or t/u
  misc_feature (200)..(200): n is a, c, g, or t/u
  misc_feature (245)..(245): n is a, c, g, or t/u
  misc_feature (260)..(260): n is a, c, g, or t/u
  misc_feature (268)..(268): n is a, c, g, or t/u
  misc_feature (291)..(292): n is a, c, g, or t/u
  misc_feature (310)..(310): n is a, c, g, or t/u
  misc_feature (317)..(317): n is a, c, g, or t/u
  misc_feature (329)..(329): n is a, c, g, or t/u
  misc_feature (355)..(355): n is a, c, g, or t/u
  misc_feature (364)..(364): n is a, c, g, or t/u
  misc_feature (374)..(374): n is a, c, g, or t/u
  misc_feature (397)..(397): n is a, c, g, or t/u
  misc_feature (401)..(401): n is a, c, g, or t/u
  misc_feature (416)..(416): n is a, c, g, or t/u
acacgtntaacattccctttattgcttacgtcncatattccaatgaatacaataaactcctttttaaaaaagtaaggcncatgaaaagccttttgngtaagttccatgttattttaaaattcctatnggctaataaaagcntttgcactatanaaccnganacatntanaaaagcncatgatngatttttttgcaagcanaatgcctgaaacattacatttaccttatggcacaatgagacagtnaccaaatccaatgtntgcattanaacgatacagctacttttacagnngcgaaaccattaattagnttatccncatatgtacagntgggtccccacgtgacaaaatctggngccgaattntttggatccnctaatgtcgaccctgcaggcgcncgangctccaagcttttgntcccctttta

SEQ ID NO: 169 - DNA, 651 bp, Homo sapiens
  misc_feature (591)..(591): n is a, c, g, or t/u
  misc_feature (628)..(628): n is a, c, g, or t/u
gtctggtgccagcagccgcggtaattccagctccaatagcgtatattaaagttgctgcagttaaaaagctcgtagttggatcttgggagcgggcgggcggtccgccgcgaggcgagccaccgcccgtccccgccccttgcctctcggcgccccctcgatgctcttagctgagtgtcccgcggggcccgaagcgtttactttgaaaaaattagagtgttcaaagcaggcccgagccgcctggataccgcagctaggaataatggaataggaccgcggttctattttgttggttttcggaactgaggccatgattaagagggacggccgggggcattcgtattgcgccgctagaggtgaaattcttggaccggcgcaagacggaccagagcgaaagcatttgccaagaatgttttcattaatcaagaacgaaagtcggaggttcgaagacgatcagataccgtcgtagttccgaccataaacgatgccgaccggcgatgcggcggcgttattcccatgacccgccgggcagcttccccgaaccggtgacggtgtcgtggaactaagcccctgaccagcggcgtgcacaccttnccgggtgtcctacaagtctcaggactctattcctcancaacgtggtgaccgtgcccttca

SEQ ID NO: 170 - DNA, 636 bp, Homo sapiens; identical to SEQ ID NO: 77
  misc_feature (36)..(36): n is a, c, g, or t/u
  misc_feature (171)..(171): n is a, c, g, or t/u
  misc_feature (177)..(177): n is a, c, g, or t/u
  misc_feature (179)..(179): n is a, c, g, or t/u
  misc_feature (468)..(468): n is a, c, g, or t/u
  misc_feature (555)..(555): n is a, c, g, or t/u
  misc_feature (587)..(587): n is a, c, g, or t/u

SEQ ID NO: 171 - DNA, 687 bp, Homo sapiens; identical to SEQ ID NO: 78
  misc_feature (228)..(228): n is a, c, g, or t/u
  misc_feature (235)..(235): n is a, c, g, or t/u
  misc_feature (564)..(564): n is a, c, g, or t/u
  misc_feature (583)..(583): n is a, c, g, or t/u
  misc_feature (595)..(595): n is a, c, g, or t/u
  misc_feature (638)..(638): n is a, c, g, or t/u
  misc_feature (641)..(641): n is a, c, g, or t/u
  misc_feature (658)..(658): n is a, c, g, or t/u
  misc_feature (683)..(683): n is a, c, g, or t/u

SEQ ID NO: 172 - DNA, 617 bp, Homo sapiens
  misc_feature (10)..(11): n is a, c, g, or t/u
  misc_feature (14)..(14): n is a, c, g, or t/u
  misc_feature (25)..(25): n is a, c, g, or t/u
  misc_feature (31)..(31): n is a, c, g, or t/u
  misc_feature (81)..(81): n is a, c, g, or t/u
  misc_feature (87)..(87): n is a, c, g, or t/u
  misc_feature (112)..(113): n is a, c, g, or t/u
  misc_feature (121)..(122): n is a, c, g, or t/u
  misc_feature (129)..(131): n is a, c, g, or t/u
  misc_feature (140)..(140): n is a, c, g, or t/u
  misc_feature (175)..(175): n is a, c, g, or t/u
  misc_feature (180)..(183): n is a, c, g, or t/u
  misc_feature (190)..(190): n is a, c, g, or t/u
  misc_feature (195)..(195): n is a, c, g, or t/u
  misc_feature (198)..(198): n is a, c, g, or t/u
  misc_feature (200)..(200): n is a, c, g, or t/u
  misc_feature (223)..(223): n is a, c, g, or t/u
  misc_feature (248)..(248): n is a, c, g, or t/u
  misc_feature (276)..(276): n is a, c, g, or t/u
  misc_feature (308)..(308): n is a, c, g, or t/u
  misc_feature (342)..(342): n is a, c, g, or t/u
  misc_feature (345)..(345): n is a, c, g, or t/u
  misc_feature (354)..(354): n is a, c, g, or t/u
  misc_feature (369)..(369): n is a, c, g, or t/u
  misc_feature (379)..(379): n is a, c, g, or t/u
  misc_feature (387)..(387): n is a, c, g, or t/u
  misc_feature (397)..(399): n is a, c, g, or t/u
  misc_feature (404)..(404): n is a, c, g, or t/u
  misc_feature (420)..(421): n is a, c, g, or t/u
  misc_feature (435)..(435): n is a, c, g, or t/u
  misc_feature (441)..(441): n is a, c, g, or t/u
  misc_feature (450)..(450): n is a, c, g, or t/u
  misc_feature (452)..(453): n is a, c, g, or t/u
  misc_feature (459)..(459): n is a, c, g, or t/u
  misc_feature (461)..(462): n is a, c, g, or t/u
  misc_feature (464)..(464): n is a, c, g, or t/u
  misc_feature (470)..(470): n is a, c, g, or t/u
  misc_feature (472)..(472): n is a, c, g, or t/u
  misc_feature (475)..(475): n is a, c, g, or t/u
  misc_feature (480)..(480): n is a, c, g, or t/u
  misc_feature (485)..(485): n is a, c, g, or t/u
  misc_feature (489)..(489): n is a, c, g, or t/u
  misc_feature (497)..(498): n is a, c, g, or t/u
  misc_feature (503)..(504): n is a, c, g, or t/u
  misc_feature (515)..(515): n is a, c, g, or t/u
  misc_feature (523)..(523): n is a, c, g, or t/u
  misc_feature (526)..(527): n is a, c, g, or t/u
  misc_feature (530)..(530): n is a, c, g, or t/u
  misc_feature (537)..(537): n is a, c, g, or t/u
  misc_feature (547)..(547): n is a, c, g, or t/u
  misc_feature (550)..(551): n is a, c, g, or t/u
  misc_feature (554)..(554): n is a, c, g, or t/u
  misc_feature (558)..(558): n is a, c, g, or t/u
  misc_feature (560)..(561): n is a, c, g, or t/u
  misc_feature (567)..(567): n is a, c, g, or t/u
  misc_feature (572)..(572): n is a, c, g, or t/u
  misc_feature (574)..(574): n is a, c, g, or t/u
  misc_feature (594)..(594): n is a, c, g, or t/u
  misc_feature (597)..(597): n is a, c, g, or t/u
gatgaacgannttntggcagagtcngctaangaactccctcaagtttcatttgtgaagccggaagctgaaggtgttcctgnagtatntgaaaaatatgagattagctctgtnnccactttnntgttttnnnagaattctnacaaaatccaccgattgtatggcgctgcatgcccnaaagnnnnccctaantgacnttngnctgtgcatctctcggttccttcntacccagcgctaatgaacatcttanagaagatctcaaccttcgcttgaagaanttgactcatgctgccccctgcatgctgctatnaaaggaactcctcagaaccacgctgtggtttcancangcagatggnggaaattcttcacanacataatatncagtttancagtttttgnnntcatntcagatgaaaaggttnnacagggacttaaancctatnccagctggncnncctaancnnanctctangnttntgganagctnatangaggactnnctttnnttaaggagcgngaagcatnttnnagnaactttnattccaattnggnnccnaaancnncccaanttttntngaaaagctcaaacgtgcttnacnaataaaagctttccttgtgg

SEQ ID NO: 173 - DNA, 733 bp, Homo sapiens; identical to SEQ ID NO: 80
  misc_feature (206)..(206): n is a, c, g, or t/u
  misc_feature (544)..(544): n is a, c, g, or t/u
  misc_feature (594)..(594): n is a, c, g, or t/u
  misc_feature (609)..(609): n is a, c, g, or t/u
  misc_feature (629)..(629): n is a, c, g, or t/u
  misc_feature (634)..(634): n is a, c, g, or t/u
  misc_feature (639)..(639): n is a, c, g, or t/u
  misc_feature (650)..(650): n is a, c, g, or t/u
  misc_feature (670)..(670): n is a, c, g, or t/u
  misc_feature (686)..(686): n is a, c, g, or t/u

SEQ ID NO: 174 - DNA, 651 bp, Homo sapiens
  misc_feature (468)..(468): n is a, c, g, or t/u
  misc_feature (585)..(585): n is a, c, g, or t/u
  misc_feature (630)..(630): n is a, c, g, or t/u
ggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagaagcgcatggtgctgtgcagccagcagtggaagctgctgtcccagaaggagaaggacgcctatnacaagaagtgtgatcagaaaaagaaagattacgaggtggagctgctccgtttcctcgagagcctgcctgaggagggagcagcagcgggtcttgggggaagagaagatgctgaacatnaacaagaagcaggccaccagccccgcctccaagaagccagtccangaagggggcaaagggccggct

SEQ ID NO: 175 - DNA, 671 bp, Homo sapiens
  misc_feature (538)..(538): n is a, c, g, or t/u
  misc_feature (575)..(575): n is a, c, g, or t/u
  misc_feature (579)..(579): n is a, c, g, or t/u
  misc_feature (585)..(585): n is a, c, g, or t/u
  misc_feature (647)..(647): n is a, c, g, or t/u
  misc_feature (656)..(656): n is a, c, g, or t/u
aaagaaagaaagaaagtgggggaggccaggggggcaagggacagaacatgggggagaaacaaaggtggtcagttggggaggggagctcctgggctctccctggctgccctggggtggggctgagcctcagttggagtcagagtctgaggagtcccctgaggaggaggagctggagctgctgccctcggactcattatcttcatcctcatcgtcatcctcgtcgtcgtcttcgtcctcgtcatcctcatcctcttcatcatcctcctcggactccgacttggactgcagagtagtccggctggatttggggtttgggcctcgcagcttggtcatgctcttacgtttattggagatgtactctttatatgctgcacggtcctggggagacaggctcttaacccagaggtccaggtgcaccttgtactgcttttgctgctcctcggccagctttttgtaagtgctccttctggctctgggagatgcgctgccagcgactgccgatctccaccatgcgctccttcagcggcaggtgggtcanctccccattggaacagcagctcctgggaagaacttcntggntaaccngttcatggggaaggctttctttggggttcttcccttgggaaatttcatctttcttgggaaanaatttgtanccaatcttgggaggt

SEQ ID NO: 176 - DNA, 902 bp, Homo sapiens
  misc_feature (701)..(701): n is a, c, g, or t/u
  misc_feature (746)..(746): n is a, c, g, or t/u
  misc_feature (757)..(757): n is a, c, g, or t/u
  misc_feature (768)..(768): n is a, c, g, or t/u
  misc_feature (817)..(817): n is a, c, g, or t/u
  misc_feature (829)..(829): n is a, c, g, or t/u
  misc_feature (835)..(835): n is a, c, g, or t/u
  misc_feature (838)..(838): n is a, c, g, or t/u
  misc_feature (854)..(854): n is a, c, g, or t/u
caaattatcagcactttttattaatttgatcagtgatccttcacgttgggttcgccaagcagcttttcagtctctgggacctttcatatctacttttgctaatccatctagctcaggccagtattttaaagaagaaagcaaaagttcagaagagatgtcagtagaaaacaaaaataggaccagagatcaagaagccccagaggatgtacaagtcaggccagaggatactccttcagatctcagtgttagtaattccagtgtcatactggaaaacacgatggaagaccatgctgctgaggcatccgggaagcctctaggtgaaattagtgttccactggacagctctttactttgtactttgtcctcagaatctcaccaggaagcagctagtaatgagaatgataaaaaacctggtaactacaaatctatgttacgaccagaggttggcaccacttcacaagattcagctctcttagatcaggaattgtataactccttccatttctggaggactcctcttcctgaaatagatctagacatagagcttgaacagaactctgggggaaaacccagcccagagggaccagaggaagaatctgagggccctgtgcccagttctccaaacatcaccatggccaccagaaaggaactggaagaaatgatagaaaatctagagccccccattgatgatccagatggtnaagcacaagttggaagtgctgtccgctgcactacgtgctttcaancctgggatgcncatgaagaganccatcggttttagaaaaggagaagtggtttgccaagatgaaccgggatntaaatgagcttncccaantgntaaataaatcaagaanaatctgggccttttaatcaacggaggctggtggagaaaattgggcctc

SEQ ID NO: 177 - DNA, 700 bp, Homo sapiens
  misc_feature (155)..(155): n is a, c, g, or t/u
  misc_feature (413)..(413): n is a, c, g, or t/u
  misc_feature (426)..(426): n is a, c, g, or t/u
  misc_feature (433)..(433): n is a, c, g, or t/u
  misc_feature (521)..(521): n is a, c, g, or t/u
  misc_feature (565)..(565): n is a, c, g, or t/u
  misc_feature (582)..(582): n is a, c, g, or t/u
  misc_feature (587)..(587): n is a, c, g, or t/u
  misc_feature (602)..(602): n is a, c, g, or t/u
  misc_feature (637)..(637): n is a, c, g, or t/u
  misc_feature (651)..(651): n is a, c, g, or t/u
  misc_feature (654)..(654): n is a, c, g, or t/u
  misc_feature (681)..(681): n is a, c, g, or t/u
aaaagacaaatattttaatctagtttccccactttaaatcattaatacaggtcacaaattgcatttattggtagacatctagaaaacaatcaaaagtgtatatatctctctctatagatcttattaataaattttatttggacaagagaacttgngccacaacagtttaaacagcatgattaaagactgcagcactcccaagagtggtcacaggtatgtacagtatgtgaagaagttgcacctcagagctgatcatgatcaagttaaaaacaccagacatacattataccgtctaataaatttccttcaggtcatgaccagcatgaaaaaatcagacacagacactcagcaaccattctgtaaatgtgtacagcaatatgctgcgcttaagagtttaagtcaatcctacttgngttggcatcaggncctttangagatgtaaaaacccctcctttcccatttgcacacgtcacaaacgattcacacacagggctgggctggcagctggccacagagcccancaagtccttcctgggagagaagagttagggctgatactgaaggnctttttccatctgggcnacgtntggctttcaggctgnaagaatttcatttggcgattggtaaataaaacccngagaaagccatgcnggnctctgggaatctcatcccttccataanggaaaatgctctgccattt

SEQ ID NO: 178 - DNA, 657 bp, Homo sapiens
  misc_feature (625)..(625): n is a, c, g, or t/u
  misc_feature (633)..(633): n is a, c, g, or t/u
aagagctggaggacaaggtggccgcctgccagaaggagcaggccgacttcctgccccggatagaggaaactaagtgggaggtgtgccagaaggctggcgagatctccctcctgaagcagcagctgaaggactcgcaggcggatgtgtcgcagaagttgagtgagatcgtgggactgcgctcgcagctgcgggagggccgggcttcgctgcgggagaaggaggagcagctgctcagcctgcgggactccttcagcagcaagcaggccagcctggagctgggcgaaggcgagctgcctgccgcctgcctcaagccggcgctgacccccgtggacccggccgagccacaggatgctctggccacctgcgagagcgacgaggctaagatgcgccgtcaggccggggtggccgctgccgcctccttggtttccgtggacggggaggcggaggctggcggggagagcgggacgcgggccctgcggcgggaggtggggcggctgcaggccgagctggcggctgagcggcgggcccgggagcgccagggtgccagcttcgccgaggagcgccgcgtttggcttgaggaaaaggagaaggtgatcgagtacccagaaagcagcttgcagctgancttacgtnggagatgtaccaaccgcaacccaa

SEQ ID NO: 179 - DNA, 682 bp, Homo sapiens
  misc_feature (119)..(119): n is a, c, g, or t/u
  misc_feature (141)..(141): n is a, c, g, or t/u
  misc_feature (281)..(281): n is a, c, g, or t/u
  misc_feature (283)..(283): n is a, c, g, or t/u
  misc_feature (307)..(307): n is a, c, g, or t/u
  misc_feature (338)..(338): n is a, c, g, or t/u
  misc_feature (340)..(340): n is a, c, g, or t/u
  misc_feature (347)..(347): n is a, c, g, or t/u
  misc_feature (388)..(388): n is a, c, g, or t/u
  misc_feature (430)..(430): n is a, c, g, or t/u
  misc_feature (452)..(452): n is a, c, g, or t/u
  misc_feature (455)..(455): n is a, c, g, or t/u
  misc_feature (491)..(491): n is a, c, g, or t/u
  misc_feature (506)..(506): n is a, c, g, or t/u
  misc_feature (513)..(513): n is a, c, g, or t/u
  misc_feature (521)..(521): n is a, c, g, or t/u
  misc_feature (523)..(523): n is a, c, g, or t/u
  misc_feature (541)..(541): n is a, c, g, or t/u
  misc_feature (569)..(569): n is a, c, g, or t/u
  misc_feature (628)..(628): n is a, c, g, or t/u
  misc_feature (632)..(632): n is a, c, g, or t/u
  misc_feature (637)..(637): n is a, c, g, or t/u
cttactaatgccttctcttctccctgcccctgtggcctaggcccaggttctagggcaggtacagtgaggggtgaatggaatgggcagtggtcgacaggatggcctcccacccagctcanagacctggtgaggaccacccanaagggctgtgcagagggttagaggccacacagaggggcactcatgtttttgtgggggatgcacagctcattaaacagtcaccagtcatgggaggaggctggtcaggggctaggggacttgctcacagtagttgccagctntntccaccttgccccccaaaactcantcttgggggtgggaggaagagagtgaaaaananagagatntaagggctgagggccaagcctctccaatttttattgctggngaattaaaaatttgcttttcccttcctgtcttggggagatanactctgagagggccccaaaaanaancaactgacattggcttgacctaacccctcatgccangcctaccctgggcangtgctgnaccacctnanggcgcccaggaacctctnaagtcaccttgttctttaagggcaaatnacattcaacttttcccccgcccccaaaacaagggcctccggctcaaactttgggccaangganctggnaaagtgggcaatgcaccaaaagggaaaccggaattttttttggaa

SEQ ID NO: 180 - DNA, 757 bp, Homo sapiens
  misc_feature (694)..(694): n is a, c, g, or t/u
  misc_feature (703)..(703): n is a, c, g, or t/u
  misc_feature (747)..(747): n is a, c, g, or t/u
gtgccccagggataccctggaggggtccccaccttcttccgggacatgaagcagggcctgctgtctgtgggcattggtggccgggagtcccggaatggctgcctggacgtggagaaggactgttccatcaccaagttcctgaaccgcatcctggggctggaggtgcacaagcagaacgccctgttccagtacttctcagacaccttcgaccacctcatcgagatggacaagcgggagggcaaatacgacatgggcatcctggaccttgctcccggtatcgaggagatctacgaggagagccagcaggtgttcctggctcccgggcacccgcaggacgggcaggtggtcttctacaagatcagcgtggaccgcggcctgaagtgggaggacgcctttgccaagtcgctggcgctgacgggcccctatgacggcttctacctctcctacaaggtccgcggtaacaagcccagctgcctgctggcggagcagaaccgcggccagttcttcacggtgtacaagcccaacatcggccggcagagccagctggaggccctggacagcctccgccgcaagttccaccgggtcaccgcggaggaggccaaaggagccctgggagagtggctacgctttgtcgctgacgcactgcaagccacagcgcctggaaccggcacttgccgcttggcgcaagaaggtnaaggactgnctgcaggggcttgcgggttgcggcaccaattacatgcttgtgcngcgccccttt

SEQ ID NO: 181 - DNA, 695 bp, Homo sapiens
  misc_feature (411)..(411): n is a, c, g, or t/u
  misc_feature (434)..(434): n is a, c, g, or t/u
  misc_feature (474)..(474): n is a, c, g, or t/u
  misc_feature (521)..(521): n is a, c, g, or t/u
  misc_feature (532)..(532): n is a, c, g, or t/u
  misc_feature (579)..(579): n is a, c, g, or t/u
  misc_feature (612)..(612): n is a, c, g, or t/u
  misc_feature (615)..(615): n is a, c, g, or t/u
  misc_feature (627)..(627): n is a, c, g, or t/u
  misc_feature (643)..(643): n is a, c, g, or t/u
  misc_feature (646)..(646): n is a, c, g, or t/u
  misc_feature (661)..(661): n is a, c, g, or t/u
  misc_feature (668)..(668): n is a, c, g, or t/u
  misc_feature (683)..(683): n is a, c, g, or t/u
gtttttttaggcaaaaggcacatatatttaaaaaagtcctttacatatgtacatcagaacttgctataaatacatagaaaccgcaggcgccaccctgccagctccgcggcctggggcctgggagaggtgagcgggcaataacttaggggtcagggaagggctgggggagggagaattgcatatattagcaggggtctgccccacggagcccccgagacgcggggccctgagcacctggggtttcctgagtttctagctcttgggaccacccggtttcacggatttcaagggtttgggcccactgagcccttgtgggtgcccagtcccagagcagccacccggagccccttcctacttgggaggagaggcacagagagggccctgccacgccccggcccccagctgtctgantgggccccgcaaggctgaccaangtgggggcccgggtcgggcgcttaaagcacttgcggccanggcctaaggctcctctgagcagtggtcaagggaccttggcccttctncccaccggtgnttctaggggagaaacgtccctgtgtcttggggcatgtttcgctaaangcgtgtcaaaaaagaacctgggcgcccgggaanggntgggcttaactngatcacgctcttgcgnttngggaccaacggcccngcggggnccccccggcccccgnggcccttcccca

SEQ ID NO: 182 - DNA, 817 bp, Homo sapiens
  misc_feature (635)..(635): n is a, c, g, or t/u
  misc_feature (785)..(785): n is a, c, g, or t/u
  misc_feature (789)..(789): n is a, c, g, or t/u
  misc_feature (795)..(795): n is a, c, g, or t/u
ttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggaacgccgccattctctggagaacaaggtaaagagactagagaccatggagcgtagagaaaacagactgaaggatgacatccagacaaaatcccaacagatccagcagatggctgataaaattctggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagangattgtggaactgtctgaagccaataaacttgcagcaaaatagcagtcttttttacccaaaggaccatgaaggccccaagaagagatgatttctgaactcaaggcaacaagaaatttttaccttgggagacaccaggcttgggaaagttnggangcccanaaaccgaaaacctgggaggagc

SEQ ID NO: 183 - DNA, 686 bp, Homo sapiens
  misc_feature (52)..(52): n is a, c, g, or t/u
  misc_feature (77)..(77): n is a, c, g, or t/u
  misc_feature (166)..(166): n is a, c, g, or t/u
  misc_feature (194)..(194): n is a, c, g, or t/u
  misc_feature (370)..(370): n is a, c, g, or t/u
  misc_feature (372)..(372): n is a, c, g, or t/u
  misc_feature (425)..(425): n is a, c, g, or t/u
  misc_feature (462)..(462): n is a, c, g, or t/u
  misc_feature (537)..(537): n is a, c, g, or t/u
  misc_feature (562)..(562): n is a, c, g, or t/u
  misc_feature (571)..(571): n is a, c, g, or t/u
  misc_feature (578)..(578): n is a, c, g, or t/u
  misc_feature (588)..(588): n is a, c, g, or t/u
  misc_feature (594)..(594): n is a, c, g, or t/u
  misc_feature (613)..(613): n is a, c, g, or t/u
  misc_feature (620)..(620): n is a, c, g, or t/u
  misc_feature (624)..(624): n is a, c, g, or t/u
  misc_feature (633)..(633): n is a, c, g, or t/u
  misc_feature (635)..(635): n is a, c, g, or t/u
  misc_feature (640)..(640): n is a, c, g, or t/u
  misc_feature (655)..(655): n is a, c, g, or t/u
  misc_feature (665)..(665): n is a, c, g, or t/u
  misc_feature (672)..(672): n is a, c, g, or t/u
  misc_feature (679)..(679): n is a, c, g, or t/u
acgaatataaagtttcttgtaaatatgtacagtcttttgagctagttctatntagcagaaagcagttcacagatganacacacaatatacattttcagggctcaagaagcccatttctcatggagatcctaaatgaaatgccaagactgaaagacccattttcagngacctttccaaatactggggaccaaganacaaaacttcagcaaacattcaatcaaatctgccctggggacgggaggggagggagtacgaccccacagactccaagcaacacataaaacgccacagcaggacatttgccaaaggagctaccacatggaggtttgtaggcgtttcaaacaagaaagcacttaggttaaaacacgancnggaaggagctgggatgcaggccaggttgcaatctggaaagggatctgaactgnggacacagttgaaaacacggtcatgttcacctgctgngggggaaacgggtctacctttgagcctacctaagaggtgcctgggtttgttgaggcgggcctaaaaatcgtggangacccaaagcaacagatgcctttgngggagattnaaggcangaaataaggnccgggngttaactttgccaactgcnaagcctnttanggtgggttntntccanttgccaagaatttcntcccttatanggagggngccgcanaacccaa

SEQ ID NO: 184 - DNA, 939 bp, Homo sapiens
  misc_feature (603)..(603): n is a, c, g, or t/u
  misc_feature (691)..(691): n is a, c, g, or t/u
  misc_feature (717)..(717): n is a, c, g, or t/u
  misc_feature (727)..(727): n is a, c, g, or t/u
  misc_feature (735)..(735): n is a, c, g, or t/u
  misc_feature (739)..(740): n is a, c, g, or t/u
  misc_feature (748)..(748): n is a, c, g, or t/u
  misc_feature (753)..(753): n is a, c, g, or t/u
  misc_feature (768)..(768): n is a, c, g, or t/u
  misc_feature (778)..(778): n is a, c, g, or t/u
  misc_feature (791)..(791): n is a, c, g, or t/u
  misc_feature (807)..(807): n is a, c, g, or t/u
  misc_feature (810)..(810): n is a, c, g, or t/u
  misc_feature (827)..(827): n is a, c, g, or t/u
  misc_feature (860)..(860): n is a, c, g, or t/u
  misc_feature (867)..(867): n is a, c, g, or t/u
  misc_feature (869)..(869): n is a, c, g, or t/u
  misc_feature (884)..(884): n is a, c, g, or t/u
  misc_feature (889)..(889): n is a, c, g, or t/u
  misc_feature (902)..(902): n is a, c, g, or t/u
  misc_feature (915)..(915): n is a, c, g, or t/u
  misc_feature (925)..(925): n is a, c, g, or t/u
agagcgccatgagtagcgaccgcatggactgtggccgcaaagtccgggtggagagcggctacttctctctggagaagaccaaacaggacttgaaggctgaagaacagcagctgcccccgccgctctcccctcccagccccagcacccccaaccacaggaggtcccaggtgattgaaaagtttgaggccttggacattgagaaggcagagcacatggagaccaatgcagtggggccctcacaatccagcgacacacgccagggccgcagcgagaagagggcgttccctaggaagcgggacttcaccaatgaagcccccccagctcctctcccagacgcctcggcttcccccctgtctccacaccgaagagccaagtcactggacaggaggtccacggagccctccgtgacgcccgacctgctgaatttcaagaaaggctggctgactaagcagtatgaggacggccagtggaagaaacactggtttgtcctcgccgatcaaagcctgagatactacagggattcagtggctgaggaggcagccgacttggatggagaaattgacttgtccgcatgttacgatgtcacagagtatccagttcaanagaaactatggcttccagatacatacaaaggagggcgaagtttacccttgtcgccatgacattttgggattcgggcggaactggatcnaaacatcatgaacacgtgcccccgancactgccccngatgtgancaanntcgtttgncaganggaaaaaacaagaanccgctggttnttttgaaacttgnccgaggccttcttganaancaaaaaggcaaaacctnggggaacccggacccttgaacaaaaaaaagaanccccccncngggaaccggaaggcnaaaanggccccttccaanaaccttttgactnggggctgaantccctcccattcca

SEQ ID NO: 185 - DNA, 692 bp, Homo sapiens
  misc_feature (421)..(421): n is a, c, g, or t/u
  misc_feature (507)..(507): n is a, c, g, or t/u
  misc_feature (518)..(518): n is a, c, g, or t/u
  misc_feature (526)..(526): n is a, c, g, or t/u
  misc_feature (561)..(561): n is a, c, g, or t/u
  misc_feature (601)..(601): n is a, c, g, or t/u
  misc_feature (625)..(625): n is a, c, g, or t/u
gtgcaagatttaataaaaaacaaacaaaaataggaatggttgctttcaacattttccaggttgtgaaaggtttgccacgactctcaggggtgtggttctaagctgcatcagtggaacaaatacaaaatgctgtcctcctcctgggctggaaggcagtgcactttctcctcttaacagccagactagcgggtgaggagtcagtgctgtgacccaggccaagctggagtgtccgcatagctttttctctgaccagtggggattccatctaccttgaggcgtgctggctgggccccgtttccacaccagcacatggtgagacagggtagcttatcaacaggctgctgggccttaatactgacagtgagtgtggcgggtcacagccaggaaaggactaacacagatgccctcccacccccactgntggcctaattttagaataccacggaaaaaagctttgatgaagacaacaggaagtcaacacagcagagagtggtgtggacaacccanaagccagcctnacgcattncatgcccacagttaacgatgaccacaaccgcaatnataataataataataaaacaaaggtccaggtgaaaaacancgcttggggtgtgctgctgcaaanctggggaaagcgcgtgctcaactttggatgggacacacctagtctttcttcaagtccctggattaaa

SEQ ID NO: 186 - DNA, 447 bp, Homo sapiens
gagagagagagacagacagacagacagagagagagagaccgacagagagacacagaaaaagaaagagagaggcagacagacagagaaagagacagacagagaaagacatagacagacagagagagacagaagacagacacagtgagacaggcagagagggagagagagagacaaagacagagacagagacagagagaaagaaagagacagacagacagagaaagagacacagagagaaagacagagacgaacagagagaaacagacagagagaaggccctagcccagtagcaatacagtgccttttctttcattttctctttcttttcttttctttttttctttcttgtatatctgtatgcatggatggatgtatgtatgtatgtatgtatgtatgtatgtatgtatgtgtgtatttatttatgtacgtatttatctggagaccggg

SEQ ID NO: 187 - DNA, 675 bp, Homo sapiens
  misc_feature (631)..(631): n is a, c, g, or t/u
  misc_feature (653)..(653): n is a, c, g, or t/u
actgtaggcactgccatggcccctgtgctcagtaaggactcggcggacatcgagagtatcctggctttaaatcctcgaacacaaactcatgcaactctgtgttccacttcggccaagaaattagacaagaaacattggaaaagaaatcctgataagaactgctttaattgtgagaagctggagaataattttgatgacatcaagcacacgactcttggtgagcgaggagctctccgagaagcaatgagatgcctgaaatgtgcagatgccccgtgtcagaagagctgtccaactaatcttgatattaaatcattcatcacaagtattgcaaacaagaactattatggagctgctaagatgatattttctgacaacccacttggtctgacttgtggaatggtatgtccaacctctgatctttgtgtaggtggatgcaatttatatgccactgaagagggacccattaatattggtggattgcagcaatttgctactgaggtatgtatgatatacaccgtgacatccccccactaccatcaccatgcacaaatatcttaaaataactttaatccttggtgctctgttgatacccacatttttagtgtgacacacagctcaagtatgttttgtncaacaaacttttttttattcancagcttaacctacaaaaaggga

SEQ ID NO: 188 - DNA, 616 bp, Homo sapiens
  misc_feature (540)..(540): n is a, c, g, or t/u
  misc_feature (589)..(589): n is a, c, g, or t/u
tggcagtggagggacggcgggtccaggccctggaggaggtgctgggagacctaagggctgagtctcgggagcaggagaaagctctgttggccctccagcagcagtgtgctgagcaggcacaggagcatgaggtggagaccagggccctgcaggacagctggctgcaggcccaggcagtgctcaaggaacgggaccaggagctggaagctctgcgggcagaaagtcagtcctcccggcatcaggaggaggctgcccgggcccgggctgaggctctgcaggaggcccttggcaaggctcatgctgccctgcaggggaaagagcagcatctcctcgagcaggcagaattgagccgcagtctggaggccagcactgcaaccctgcaagcctccctggatgcctgccaggcacacagtcggcagctggaggaggctctgaggatacaagaaggtgagatccaggaccaggatctccgataccaggaggatgtgcagcagctgcagcaggcacttgcccagagggatgaagagctgagacatcaancaggaacgggagcaagctgctggaaaaagtcttttggcccaaaagggtncaagaagaatatgatccaagaagaaac

SEQ ID NO: 189 - DNA, 667 bp, Homo sapiens
  misc_feature (615)..(615): n is a, c, g, or t/u
gaatgcaaagatctcagggtttattgttgaaggagaagatgaaggaggtggtgaagtgctaggaaaataaattctagatgagaggcagtacatgtccctcagccagggcaaggcacccctctgggtgattccatagggagcaagcaaatgcaatttgcctcattcccaggtgagttggggtcctccccagggttgcagatttacttcctcttcctgggaacacccgccgacctggggctcctgggtgcctaacagagccaggcttttcctttggcaaacctgtaggtgtgcggaggggccatgacccatgacacagtcttctgtctgtgtgctcctggctgtggctgctacctggaggcggcttgggtagtgctggggctggggtgtagcaggactggccctggggatgtcagactttgagtcagggactcatccagcctgcgggtctctgcctccaggacagtggcctcaggggcctgggccacggcaagaagtgagtgtgagaggctgtggtgcaagcctgctagctcacggctggtctgtgctgagcgggtgatgtaatcctgcttctgcttccgctccaaagtcagctgagctttgcaacaggaccacctntttttttgcagtttcagccccacacttggccatctggagttctttttgtcct

SEQ ID NO: 190 - DNA, 771 bp, Homo sapiens; identical to SEQ ID NO: 83
  misc_feature (533)..(533): n is a, c, g, or t/u
  misc_feature (595)..(595): n is a, c, g, or t/u
  misc_feature (633)..(633): n is a, c, g, or t/u
  misc_feature (656)..(656): n is a, c, g, or t/u
  misc_feature (679)..(679): n is a, c, g, or t/u
  misc_feature (705)..(705): n is a, c, g, or t/u
  misc_feature (715)..(715): n is a, c, g, or t/u
  misc_feature (766)..(766): n is a, c, g, or t/u

SEQ ID NO: 191 - DNA, 478 bp, Homo sapiens; identical to SEQ ID NO: 85

SEQ ID NO: 192 - DNA, 961 bp, Homo sapiens; identical to SEQ ID NO: 84
  misc_feature (684)..(684): n is a, c, g, or t/u
  misc_feature (689)..(689): n is a, c, g, or t/u
  misc_feature (729)..(729): n is a, c, g, or t/u
  misc_feature (738)..(738): n is a, c, g, or t/u
  misc_feature (770)..(770): n is a, c, g, or t/u
  misc_feature (777)..(777): n is a, c, g, or t/u
  misc_feature (806)..(806): n is a, c, g, or t/u
  misc_feature (819)..(819): n is a, c, g, or t/u
  misc_feature (826)..(826): n is a, c, g, or t/u
  misc_feature (833)..(833): n is a, c, g, or t/u
  misc_feature (838)..(838): n is a, c, g, or t/u
  misc_feature (842)..(842): n is a, c, g, or t/u
  misc_feature (850)..(850): n is a, c, g, or t/u
  misc_feature (854)..(854): n is a, c, g, or t/u
  misc_feature (859)..(859): n is a, c, g, or t/u
  misc_feature (870)..(870): n is a, c, g, or t/u
  misc_feature (876)..(876): n is a, c, g, or t/u
  misc_feature (885)..(885): n is a, c, g, or t/u
  misc_feature (890)..(890): n is a, c, g, or t/u
  misc_feature (901)..(901): n is a, c, g, or t/u
  misc_feature (918)..(918): n is a, c, g, or t/u
  misc_feature (958)..(958): n is a, c, g, or t/u

SEQ ID NO: 193 - DNA, 884 bp, Homo sapiens
  misc_feature (640)..(640): n is a, c, g, or t/u
  misc_feature (658)..(658): n is a, c, g, or t/u
  misc_feature (776)..(776): n is a, c, g, or t/u
  misc_feature (780)..(780): n is a, c, g, or t/u
  misc_feature (850)..(850): n is a, c, g, or t/u
  misc_feature (856)..(856): n is a, c, g, or t/u
  misc_feature (865)..(865): n is a, c, g, or t/u
  misc_feature (881)..(881): n is a, c, g, or t/u
gaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacangatgcctgcccatattanaatggagaaggaggcagtttctaaaatggcttggactttggtgaaagtcttcaacttaaggaagcttttgaaatttaatccccccaacaagagaaaatttacctttccatgccagctntttntggggggaacaaacttgcggaaacaacactttcctgaatggtttgggttcctgtccaccttgggggggcnaaaaangaacctcanggcaaagtgggaatanccc

SEQ ID NO: 194 - DNA, 622 bp, Homo sapiens
  misc_feature (327)..(327): n is a, c, g, or t/u
  misc_feature (478)..(478): n is a, c, g, or t/u
  misc_feature (481)..(481): n is a, c, g, or t/u
  misc_feature (490)..(490): n is a, c, g, or t/u
  misc_feature (519)..(519): n is a, c, g, or t/u
  misc_feature (581)..(581): n is a, c, g, or t/u
  misc_feature (586)..(586): n is a, c, g, or t/u
  misc_feature (588)..(588): n is a, c, g, or t/u
  misc_feature (607)..(607): n is a, c, g, or t/u
aagaacttatttttattttattttagaacttaaaaataaatttttaagaactaaaaaagtgaaagagcccagtggctgagcagaaaacagcttactacaaggagtaccagatcagggcagagacttcccagctgggtaaggcatgctttgagggaagactccaccagccctgccaggaaagggcagcaggcgcagtgcccctatggggcccacatggctggtaacagcagcaggacacctcttccaaagctgtccaccagccccactaggggctcctactcatggcaaaaaagactacatgagcccacaactgtcaactaacacagngccacctcctcccaaagcaaacacatatacatacaatgttaagaacctattatcagaacagcagtgcagcagaccctggccttggtctctgaaagtcctgtgtcactggctgtaaggacgcttgggcacaggttccttctccttctcccgnttnagccattgntctaggagtcctgcagtgcctctcttggnggggaggggactcttctgcaggaactgactggaccactggggaacatctgactcttcctttngaggngnttttgagtcttcctttttngggggacttttgggg

SEQ ID NO: 195 - DNA, 830 bp, Homo sapiens; identical to SEQ ID NO: 86
  misc_feature (616)..(616): n is a, c, g, or t/u
  misc_feature (618)..(618): n is a, c, g, or t/u
  misc_feature (676)..(676): n is a, c, g, or t/u
  misc_feature (679)..(679): n is a, c, g, or t/u
  misc_feature (691)..(691): n is a, c, g, or t/u
  misc_feature (727)..(727): n is a, c, g, or t/u
  misc_feature (741)..(741): n is a, c, g, or t/u
  misc_feature (757)..(757): n is a, c, g, or t/u
  misc_feature (759)..(759): n is a, c, g, or t/u
  misc_feature (762)..(762): n is a, c, g, or t/u
  misc_feature (789)..(789): n is a, c, g, or t/u
  misc_feature (827)..(827): n is a, c, g, or t/u

SEQ ID NO: 196 - DNA, 747 bp, Homo sapiens; identical to SEQ ID NO: 87
  misc_feature (549)..(549): n is a, c, g, or t/u
  misc_feature (596)..(596): n is a, c, g, or t/u
  misc_feature (661)..(661): n is a, c, g, or t/u
  misc_feature (672)..(672): n is a, c, g, or t/u
  misc_feature (691)..(691): n is a, c, g, or t/u
  misc_feature (729)..(729): n is a, c, g, or t/u
  misc_feature (736)..(736): n is a, c, g, or t/u

SEQ ID NO: 197 - DNA, 539 bp, Homo sapiens
  misc_feature (441)..(441): n is a, c, g, or t/u
  misc_feature (512)..(512): n is a, c, g, or t/u
  misc_feature (529)..(529): n is a, c, g, or t/u
ctctgcttagtatatgtttacatgcctaatggttcattgctagacagactctcttgcttggatggtactccaccactttcttggcacatgagatgcaagattgctcagggtgcagctaatggcatcaattttctacatgaaaatcatcatattcatagagatattaaaagtgcaaatatcttactggatgaagcttttactgctaaaatatctgactttggccttgcacgggcttctgagaagtttgcccagacagtcatgactagcagaattgtgggaacaacagcttatatggcaccagaagctttgcgtggagaaataacacccaaatctgatatttacagctttggtgtggttttactagaaataataactggacttccagctgtggatgaacaccgggaacctcagttattgctagatattaaaagaagaaattgnagatgaagaaaagacaattgaagattatattgataaaaagatgaatgatgctgattccacttcagttgaanctatgtacctctgttgntagtcaatgt

SEQ ID NO: 198 - DNA, 630 bp, Homo sapiens; identical to SEQ ID NO: 91
  misc_feature (467)..(467): n is a, c, g, or t/u
  misc_feature (493)..(493): n is a, c, g, or t/u
  misc_feature (547)..(547): n is a, c, g, or t/u
  misc_feature (559)..(559): n is a, c, g, or t/u
  misc_feature (575)..(575): n is a, c, g, or t/u
  misc_feature (578)..(578): n is a, c, g, or t/u
  misc_feature (595)..(595): n is a, c, g, or t/u
  misc_feature (602)..(602): n is a, c, g, or t/u
  misc_feature (615)..(615): n is a, c, g, or t/u

SEQ ID NO: 199 - DNA, 846 bp, Homo sapiens; identical to SEQ ID NO: 94
  misc_feature (713)..(713): n is a, c, g, or t/u
  misc_feature (779)..(779): n is a, c, g, or t/u
  misc_feature (814)..(814): n is a, c, g, or t/u

SEQ ID NO: 200 - DNA, 505 bp, Homo sapiens; identical to SEQ ID NO: 95
  misc_feature (21)..(21): n is a, c, g, or t/u
  misc_feature (51)..(51): n is a, c, g, or t/u
  misc_feature (60)..(60): n is a, c, g, or t/u
  misc_feature (79)..(79): n is a, c, g, or t/u
  misc_feature (102)..(102): n is a, c, g, or t/u
  misc_feature (158)..(158): n is a, c, g, or t/u
  misc_feature (177)..(177): n is a, c, g, or t/u
  misc_feature (200)..(200): n is a, c, g, or t/u
  misc_feature (208)..(208): n is a, c, g, or t/u
  misc_feature (219)..(219): n is a, c, g, or t/u
  misc_feature (226)..(226): n is a, c, g, or t/u
  misc_feature (241)..(241): n is a, c, g, or t/u
  misc_feature (249)..(249): n is a, c, g, or t/u
  misc_feature (252)..(252): n is a, c, g, or t/u
  misc_feature (258)..(258): n is a, c, g, or t/u
  misc_feature (308)..(308): n is a, c, g, or t/u
  misc_feature (319)..(319): n is a, c, g, or t/u
  misc_feature (330)..(330): n is a, c, g, or t/u
  misc_feature (337)..(337): n is a, c, g, or t/u
  misc_feature (352)..(352): n is a, c, g, or t/u
  misc_feature (356)..(356): n is a, c, g, or t/u
  misc_feature (368)..(368): n is a, c, g, or t/u
  misc_feature (376)..(376): n is a, c, g, or t/u
  misc_feature (378)..(378): n is a, c, g, or t/u
  misc_feature (406)..(406): n is a, c, g, or t/u
  misc_feature (411)..(411): n is a, c, g, or t/u
  misc_feature (425)..(425): n is a, c, g, or t/u
  misc_feature (471)..(472): n is a, c, g, or t/u
  misc_feature (496)..(496): n is a, c, g, or t/u

SEQ ID NO: 201 - DNA, 580 bp, Homo sapiens
  misc_feature (412)..(412): n is a, c, g, or t/u
  misc_feature (491)..(491): n is a, c, g, or t/u
  misc_feature (503)..(503): n is a, c, g, or t/u
attcgggacaaagcaaggaaagagaagaatgagcttgtccgtcagctggtagctttcattcgtaaaagagataaaagagtgcaggcgcatcgaaaacttgtggaagaacagaatgcatgagaaggcgaggaaagccgaagagatgaggcggcagcagaagctaaagcaggccaaactggtggagcagtacagagaacagagctggatgactatggccaatttggagaaagagctccaggagatggaggcacggtacgagaaggagtttggagatggatcggatgaaaatgaaatggaagaacatgaactcaaagatgaggaggatggtaaagacagtgatgaggccgaggacgctgagctctatgatgacctttactgcccagcatgtgacaaatcgttcaagacagaaaangccatgaagaatcacgagaagtcaaagaagcatcgggaaatggtggccttgctaaaacaacagctggaggaggaagaanaaaatttttcangacctcaaattgatgaaaatccattagatgacaattctgaggaagaaatggaagatgcaccaaaacaaaagctttct

SEQ ID NO: 202 - DNA, 579 bp, Homo sapiens
  misc_feature (572)..(572): n is a, c, g, or t/u
agaaagcttttgttttggtgcatcttccatttcttcctcagaattgtcatctaatggattttcatcaatttgaggtcttgaaaaattttcttcttcctcctccagctgttgttttagcaaggccaccatttcccgatgcttctttgacttctcgtgattcttcatggccttttctgtcttgaacgatttgtcacatgctgggcagtaaaggtcatcatagagctcagcgtcctcggcctcatcactgtctttaccatcctcctcatctttgagttcatgttcttccatttcattttcatccgatccatctccaaactccttctcgtaccgtgcctccatctcctggagctctttctccaaattggccatagtcatccagctctgttctctgtactgctccaccagtttggcctgctttagcttctgctgccgcctcatctcttcggctttcctcgccttctctgcattctgttcttccacaagttttcgatgcgcctgcactcttttatctcttttacgaatgaaagctaccagctgacggacaagctcattcttctctttccttgctttgncccgaat

SEQ ID NO: 203 - DNA, 808 bp, Homo sapiens
  misc_feature (673)..(673): n is a, c, g, or t/u
  misc_feature (676)..(676): n is a, c, g, or t/u
  misc_feature (748)..(748): n is a, c, g, or t/u
ctgcagtgcaagccagcagtggtagtcccaaagccagaaccactgagggaccagtggactccatgccatgcctggaccggatgccacttctggccaagggcaagcaggcaacaggggaagagaaagcagcaacagctccaggtgcaggtgccaaggccagtggggagggcatggcaggtgatgcagcaggagagacagagggcagcatggagaggatgggagagccttcccaggacccaaagcagggcacatcaggtggtgtggacacaagctctgagcaaatcgccaccctcactggcttcccagacttcagggagcacatcgccaagatcttcgagaagcctgtgctcggagccctggccacacctggagaaaaggcaggagctgggaggagtgcagtgggtaaagacctcaccaggccattgggcccagagaagcttctagatgggcctccaggagtggatgtcacccttctccctgcacctcctgctcgactccaggtggagaagaagcaacagttggctggagaggctgagatttcccatctggctctgcaagatccagcttcagacaagcttctgggtccagcagggctgacctgggagcggaacttgccaggtgccggtgtggggaaggagatggcaggttgtcccacccacactgagggaagacnaanaggccagaagggcctggggcagcctggccaggcctggaaagccaggcttacttacagcttggagaagaacangcaggaattactttaaggtctttcttttaccagcagctacttaaggagcttccttgtgga

SEQ ID NO: 204 - DNA, 696 bp, Homo sapiens
  misc_feature (34)..(34): n is a, c, g, or t/u
  misc_feature (104)..(104): n is a, c, g, or t/u
  misc_feature (389)..(389): n is a, c, g, or t/u
  misc_feature (511)..(511): n is a, c, g, or t/u
  misc_feature (575)..(575): n is a, c, g, or t/u
  misc_feature (591)..(591): n is a, c, g, or t/u
  misc_feature (636)..(636): n is a, c, g, or t/u
  misc_feature (669)..(669): n is a, c, g, or t/u
  misc_feature (678)..(678): n is a, c, g, or t/u
ctaatttataaattttaattttacaatttaaagngattaaaacaacaagtcatgaaatatttattgtactactatacatctggccctgccttctccaagaaggngctaacatgtttaaggactctgaaaaagaaggcactgatatggtcatttttggggtggggaagacttttccaagctagacagatatttctcctgccccttaactgggaatataaaaaatacataacagcaaaggctgcaggaaattgtatcctaagtcagtagcaaaaaagggtgtccaatgcagattaaacttgcatctgtttggccagcacatgcccacatccacattggctcagagctatgggagtcactactgccaggcggcagaggcagctgggtgtcantggaagtgttcaaactcgaaaaacaggtgatcgtgcattctttctgaatgtgcaaaatatgaatcagatcatttataaaatgcctgcagctgtttggtagggtcacaggtctaatttaaagnctgattccccctactcatacacacaagtgttgtatgcatgtatatgtgtgcacacacagcaccngaacagccaaaggctngggaggcggaaagcttgttcctgtgtgtctgtgtacgtgcacaanatccccttttcccaaaaggatgaaaccttgganagcagcttntgcataacactagggggg

SEQ ID NO: 205 - DNA, 494 bp, Homo sapiens
  misc_feature (101)..(101): n is a, c, g, or t/u
  misc_feature (109)..(109): n is a, c, g, or t/u
  misc_feature (232)..(233): n is a, c, g, or t/u
  misc_feature (242)..(242): n is a, c, g, or t/u
  misc_feature (244)..(244): n is a, c, g, or t/u
  misc_feature (263)..(263): n is a, c, g, or t/u
  misc_feature (278)..(278): n is a, c, g, or t/u
  misc_feature (327)..(327): n is a, c, g, or t/u
  misc_feature (332)..(332): n is a, c, g, or t/u
  misc_feature (342)..(343): n is a, c, g, or t/u
  misc_feature (370)..(370): n is a, c, g, or t/u
  misc_feature (385)..(385): n is a, c, g, or t/u
  misc_feature (392)..(392): n is a, c, g, or t/u
  misc_feature (403)..(403): n is a, c, g, or t/u
  misc_feature (410)..(410): n is a, c, g, or t/u
  misc_feature (412)..(412): n is a, c, g, or t/u
  misc_feature (414)..(415): n is a, c, g, or t/u
  misc_feature (426)..(426): n is a, c, g, or t/u
  misc_feature (430)..(430): n is a, c, g, or t/u
  misc_feature (432)..(432): n is a, c, g, or t/u
  misc_feature (443)..(443): n is a, c, g, or t/u
  misc_feature (449)..(449): n is a, c, g, or t/u
  misc_feature (462)..(462): n is a, c, g, or t/u
  misc_feature (482)..(482): n is a, c, g, or t/u
  misc_feature (489)..(489): n is a, c, g, or t/u
gcctggcctgcccttgcgcccggctccccagtgcccgccgcccgcccgccgcgctcccgcgctccgttccgcccaggccgcagcccagctggaatgcaaanatcgccgnccggctacggcgcacaggacgacccgcccgcccgccgcgactgtgcatgggccccgggacacggggccgccgctgacacgcgcggcctcaccgccggccccgccgccctcgccgcgcccgccnngcccgcctngncgcccagcccgcagcgcantcccccgcgcaaccncgagccggggcgctatggcctcagcccggccggccgcggggaacgccangcggnatacgagtcnngcatcccgctggcccatgaacgccttnatggggtgggcaaanggacgancagcaagctgnctggctnananntaacccggacntgcnanaacgcggtggntcaacnaagatgctggggnaaaagcgtgtgaaggagctngaacgcngcgga

SEQ ID NO: 206 - DNA, 1315 bp, Homo sapiens
ggctgggtaggcgacccggacggagggccggcgaggtgcggggtctggtgatgcgagctgcgcctctcggcaagatttcgcgctgcccatcccgggccctttcatcagtaatcggtagtggatcactctgccaagcggcaggaagaattaaggaaacgacaaggagacgctcggctctctcccgcttggctccttgcggcctcctcttcccttcgctccggcccggtgaaactgaacttataatcgtcactggattgtaagtacccgaggcgaagagagctcgctgagccctgattttttgagtgtctttgttccgggagagtttgtgagttgaaagtatctctgctgggctttctgggccgaaaaccgttccgggggagccgccatttgctttcctgttccctagctagctagctagctctctccgcgttgtccggcagcggcacctagaggttgggacttggcattgcatctgatttaatgaacttaagtctgtgaataagcctttgtgttaacgactggtattcggtcacagcatatttagagaaaagacttggagcttaaataaaaactaaggcaaaatagacgcttagctgctgatctacagagaacttcttgtaattaaaagatttcaattcatagcaaactggtgttttaaactattgcagtagctggaactttttagtgtaaccagcatttattggagaagtgaatcacaaggaaataaagatgagtaaaagcaaagatgatgctcctcacgaactggagagccagtttatcttacgtctgcctccagaatatgcctctactgtgagaagggcagtacagtctggtcatgtcaacctcaaggacagactgacaattgagttacatcctgatgggcgtcatggaatcgtcagagtggaccgtgttccattggcctcaaaattagtagacctgccctgtgttatggaaagcttgaaaaccattgataaaaaaactttttacaagacagctgatatctgtcagatgcttgtatccacagttgatggtgatctctatcctcctgtggaggagccagttgctagcactgatcctaaagcaagcaagaaaaaggataaggacaaagagaaaaagtttatctggaaccacggaattactctgcctctaaagaatgtcaggaagaaaaaggttccggaagacagccaaagaagaaatatattgaatctccagatgttgaaaaagaagtgaaacgatgctgagtacagatgctgaaactgtaatactcggggggaaaaaattgcggaagatgaaacaaggaggccgaaaatcaagg

SEQ ID NO: 207 - DNA, 623 bp, Homo sapiens
agctagctagctctctccgcgttgtccggcagcggcacctagaggttgggacttggcattgcatctgatttaatgaacttaagtctgtgaataagcctttgtgttaacgactggtattcggtcacagcatatttagagaaaagacttggagcttaaataaaaactaaggcaaaatagacgcttagctgctgatctacagagaacttcttgtaattaaaagatttcaattcatagcaaactggtgttttaaactattgcagtagctggaactttttagtgtaaccagcatttattggagaagtgaatcacaaggaaataaagatgagtaaaagcaaagatgatgctcctcacgaactggagagccagtttatcttacgtctgcctccagaatatgcctctactgtgagaagggcagtacagtctggtcatgtcaacctcaaggacagactgacaattgagttacatcctgatgggcgtcatggaatcgtcagagtggaccgtgttccattggcctcaaaattagtagacctgccctgtgttatggaaagcttgaaaaccattgataaaaaaactttttacaagacagctgatatctgtcagatgcttgtatccacagttgatgg

SEQ ID NO: 208 - DNA, 979 bp, Homo sapiens
  misc_feature (26)..(26): n is a, c, g, or t/u
  misc_feature (64)..(64): n is a, c, g, or t/u
  misc_feature (191)..(191): n is a, c, g, or t/u
  misc_feature (194)..(194): n is a, c, g, or t/u
  misc_feature (240)..(240): n is a, c, g, or t/u
  misc_feature (643)..(643): n is a, c, g, or t/u
  misc_feature (696)..(696): n is a, c, g, or t/u
  misc_feature (699)..(699): n is a, c, g, or t/u
  misc_feature (732)..(732): n is a, c, g, or t/u
  misc_feature (758)..(758): n is a, c, g, or t/u
  misc_feature (779)..(779): n is a, c, g, or t/u
  misc_feature (782)..(782): n is a, c, g, or t/u
  misc_feature (801)..(801): n is a, c, g, or t/u
  misc_feature (810)..(810): n is a, c, g, or t/u
  misc_feature (832)..(832): n is a, c, g, or t/u
  misc_feature (857)..(857): n is a, c, g, or t/u
  misc_feature (860)..(860): n is a, c, g, or t/u
  misc_feature (862)..(862): n is a, c, g, or t/u
  misc_feature (876)..(876): n is a, c, g, or t/u
  misc_feature (883)..(883): n is a, c, g, or t/u
  misc_feature (892)..(892): n is a, c, g, or t/u
  misc_feature (926)..(926): n is a, c, g, or t/u
  misc_feature (935)..(935): n is a, c, g, or t/u
  misc_feature (946)..(946): n is a, c, g, or t/u
  misc_feature (966)..(966): n is a, c, g, or t/u
  misc_feature (969)..(969): n is a, c, g, or t/u
  misc_feature (976)..(976): n is a, c, g, or t/u
gaaaaacagatgcttttatttattgnattggaaacaacttaataatttgcatctctacatatanaaagctgctttgaataactgggaaaacaactattgcatgggaaaacatatgcaaactagcatcattgtctctagactaggttcttcttattgatctcacgtcatcacaaagcagcaacagcagcttntanaaaatggagaaacagtaaagtcctgcaatgaagctataattaaggntgaaccatacattccgctaatcctgcaactttcctacaatcatttttctgcctatacaatcctgcttcttataggatgaacacctagcaaaacaatataaatttgctgaaaaacaaaattacaaacaaatgaaagaacttaacagaacacacagcattaaaaggactaggaagagcaaggtcttaatacccagtacaataaagccaagaattttctaatgctgaccagtctgaagactgaaattaaatatcagttctttttacttctctaggagtgattctagctcctcttgcaaagagctgagttgctccttttctcggcttccttttgtttgagctcatccagtcagcctgaaatctgtcttgagagccagattttccactttcatgatgagacctcttgncgttttgccctgtcctgggctcttggagcttgcctttcatgttggcaatctgnttntgaattccataaccagctggatgggtccttcantttcctggggctggtcatctgaattnattaacttgggcctggactgnctntccaaaacttcctcggggnaagaaggtnatatcttcttatctgggaggcnggggctattttatcccactggtggnggngngggatggaaatctncccaacncatatgttntaagaatatggcctgccgggacaaaattcttggnaaaaaatcnggcctgatttngccctttgttatttcccatnttnccccggncta

SEQ ID NO: 209 - DNA, 780 bp, Homo sapiens
  misc_feature (653)..(653): n is a, c, g, or t/u
  misc_feature (684)..(684): n is a, c, g, or t/u
  misc_feature (712)..(712): n is a, c, g, or t/u
  misc_feature (751)..(751): n is a, c, g, or t/u
ggagggccggcgaggtgcggggtctggtgatgcgagctgcgcctctcggcaagatttcgcgctgcccatcccgggccctttcatcagtaatcggtagtggatcactctgccaagcggcaggaagaattaaggaaacgacaaggagacgctcggctctctcccgcttggctccttgcggcctcctcttcccttcgctccggcccggtgaaactgaacttataatcgtcactggattgtaagtacccgaggcgaagagagctcgctgagccctgattttttgagtgtctttgttccgggagagtttgtgagttgaaagtatctctgctgggctttctgggccgaaaaccgttccgggggagccgccatttgctttcctgttccctagctagctagctagctctctccgcgttgtccggcagcggcacctagaggttgggacttggcattgcatctgatttaatgaacttaagtctgtgaataagcctttgtgttaacgactggtattcggtcacaagcatatttagagaaaagacttggagcttaaataaaaactaaggcaaaatagacgcttaactgctgatctacaaagaacttcttgtaattaaaagatttcaattcataagcaaactggtgttttaaactattgcagtaanctggaactttttagtggtaaccagcatttanttggagaagtgaaatcacaagggaaatnaagatgaagttaaaagccaaagatgatgcttccttaccnaactgggaaagccagtttaattttacgtt

SEQ ID NO: 210 - DNA, 859 bp, Homo sapiens
  misc_feature (566)..(566): n is a, c, g, or t/u
  misc_feature (650)..(650): n is a, c, g, or t/u
  misc_feature (706)..(706): n is a, c, g, or t/u
  misc_feature (713)..(713): n is a, c, g, or t/u
  misc_feature (722)..(722): n is a, c, g, or t/u
  misc_feature (730)..(730): n is a, c, g, or t/u
  misc_feature (741)..(741): n is a, c, g, or t/u
  misc_feature (778)..(778): n is a, c, g, or t/u
  misc_feature (788)..(788): n is a, c, g, or t/u
  misc_feature (800)..(800): n is a, c, g, or t/u
  misc_feature (810)..(810): n is a, c, g, or t/u
  misc_feature (832)..(832): n is a, c, g, or t/u
  misc_feature (844)..(844): n is a, c, g, or t/u
aaagtgaaaaacagatgcttttatttattgtattggaaacaacttaataatttgcatctctacatatagaaagctgctttgaataactgggaaaacaactattgcatgggaaaacatatgcaaactagcatcattgtctctagactaggttcttcttattgatctcacgtcatcacaaagcagcaacagcagcttctagaaaatggagaaacagtaaagtcctgcaatgaagctataattaaggttgaaccatacattccgctaatcctgcaactttcctacaatcatttttctgcctatacaatcctgcttcttataggatgaacacctagcaaaacaatacaaatttgctgaaaaacaaaattacaaacaaatgaaagaacttaacagaacacacagcattaaaaggactaggaagagcaaggtcttaatacccagtacaataaagccaagaattttctaatgctgaccagtctgaagactgaaattaaatatcagttctttttacttctctaggagtgattctagctcctcttgcaaagagctgagttgctccttttctcggncttccttttggttgagctcatccagtacagcctgaaatctgttcttgagagccagatttccactttcatgatgagacctcttgncggtttgccctgtcctgggctcttgggagcttggctttatggtggcaatctgcttntgaaatnccataaccngctggatngggtccttcantttcctggggctggtcatctggatcaattaacttggnctggaactgncttttccaaacnttcttcgggncaaagaaggttatatcttcttnatcttggaggcnggggctaatttaatc

SEQ ID NO: 211 - DNA, 771 bp, Homo sapiens
  misc_feature (615)..(615): n is a, c, g, or t/u
  misc_feature (654)..(654): n is a, c, g, or t/u
  misc_feature (656)..(656): n is a, c, g, or t/u
  misc_feature (665)..(665): n is a, c, g, or t/u
  misc_feature (703)..(703): n is a, c, g, or t/u
  misc_feature (756)..(756): n is a, c, g, or t/u
gaaaagacttggagcttaaataaaaactaaggcaaaatagacgcttagctgctgatctacagagaacttcttgtaattaaaagatttcaattcatagcaaactggtgttttaaactattgcagtagctggaactttttagtgtaaccagcatttattggagaagtgaatcacaaggaaataaagatgagtaaaagcaaagatgatgctcctcacgaactggagagccagtttatcttacgtctgcctccagaatatgcctctactgtgagaagggcagtacagtctggtcatgtcaacctcaaggacagactgacaattgagttacatcctgatgggcgtcatggaatcgtcagagtggaccgtgttccattggcctcaaaattagtagacctgccctgtgttatggaaagcttgaaaaccattgataaaaaaactttttacaagacagctgatatctgtcagatgcttgtatccacagttgatggtgatctctatcctcctgtggaggagccagttgctagcactgatcctaaagcaagcaagaaaaaggataaggacaaagagaaaaagtttatctggaaccacggaattactctgcctctaaagaatgtcanggaagaaaaaggttccggaagacagccaaagaagaaatntnttgaatctncagatgttgaaaaagaagtgaaacgatgctgagtacanatgctgaaactgtaatactcggggggaaaaaattgcggaagatgaaacaaggnggccgaaaatcaagg

SEQ ID NO: 212 - DNA, 855 bp, Homo sapiens
  misc_feature (245)..(245): n is a, c, g, or t/u
  misc_feature (566)..(566): n is a, c, g, or t/u
  misc_feature (608)..(608): n is a, c, g, or t/u
  misc_feature (649)..(649): n is a, c, g, or t/u
  misc_feature (707)..(707): n is a, c, g, or t/u
  misc_feature (743)..(743): n is a, c, g, or t/u
  misc_feature (745)..(745): n is a, c, g, or t/u
  misc_feature (764)..(764): n is a, c, g, or t/u
  misc_feature (770)..(770): n is a, c, g, or t/u
  misc_feature (800)..(800): n is a, c, g, or t/u
  misc_feature (808)..(808): n is a, c, g, or t/u
  misc_feature (817)..(817): n is a, c, g, or t/u
  misc_feature (823)..(823): n is a, c, g, or t/u
  misc_feature (825)..(825): n is a, c, g, or t/u
  misc_feature (842)..(842): n is a, c, g, or t/u
  misc_feature (844)..(844): n is a, c, g, or t/u
aaagtgaaaaacagatgcttttatttattgtattggaaacaacttaataatttgcatctctacatatagaaagctgctttgaataactgggaaaacaactattgcatgggaaaacatatgcaaactagcatcattgtctctagactaggttcttcttattgatctcacgtcatcacaaagcagcaacagcagcttctagaaaatggagaaacagtaaagtcctgcaatgaagctataattaaggntgaaccatacattccgctaatcctgcaactttcctacaatcatttttctgcctatacaatcctgcttcttataggatgaacacctagcaaaacaatataaatttgctgaaaaacaaaattacaaacaaatgaaagaacttaacagaacacacagcattaaaaggactaggaagagcaaggtcttaatacccagtacaataaagccaagaattttctaatgctgaccagtctgaagactgaaattaaatatcagttctttttacttctctaggagtgattctagctcctcttgcaaagagctgagttgctccttttctcggncttccttttgtttgagctcatcccagtacaagcctggaaatntgttcttgagaagccagattttccactttcatggatgaganccctcttgtcgtttttgccctgtcctgggtcttttggagccttgccctttcatggtgncaatctggcttcttgaattcccataaccccgctggntngggtcccttcatttttccnggggcnggtcattttggattccatttaaaccttggncccggtancttggcttnttccananacttttcttcccggggncnaaaggaagggt

SEQ ID NO: 213 - DNA, 679 bp, Homo sapiens
  misc_feature (5)..(5): n is a, c, g, or t/u
  misc_feature (566)..(566): n is a, c, g, or t/u
  misc_feature (646)..(646): n is a, c, g, or t/u
aaagngaaaaacagatgcttttatttattgtattggaaacaacttaataatttgcatctctacatatagaaagctgctttgaataactgggaaaacaactattgcatgggaaaacatatgcaaactagcatcattgtctctagactaggttcttcttattgatctcacgtcatcacaaagcagcaacagcagcttctagaaaatggagaaacagtaaagtcctgcaatgaagctataattaaggttgaaccatacattccgctaatcctgcaactttcctacaatcatttttctgcctatacaatcctgcttcttataggatgaacacctagcaaaacaatataaatttgctgaaaaacaaaattacaaacaaatgaaagaacttaacagaacacacagcattaaaaggactaggaagagcaaggtcttaatacccagtacaataaagccaagaattttctaatgctgaccagtctgaagactgaaattaaatatcagttctttttacttctctaggagtgattctagctcctcttgcaaagagctgagttgctccttttctcggncttccttttgtttgagctcatcccagtacaagccctgaaaatctgtcttgagagccagatttccactttcatgatgaganccctcttgtcggttttgccctgtccctggggtc

SEQ ID NO: 214 - DNA, 672 bp, Homo sapiens
  misc_feature (585)..(585): n is a, c, g, or t/u
  misc_feature (616)..(616): n is a, c, g, or t/u
ggctgggtaggcgacccggacggagggccggcgaggtgcggggtctggtgatgcgagctgcgcctctcggcaagatttcgcgctgcccatcccgggccctttcatcagtaatcggtagtggatcactctgccaagcggcaggaagaattaaggaaacgacaaggagacgctcggctctctcccgcttggctccttgcggcctcctcttcccttcgctccggcccggtgaaactgaacttataatcgtcactggattgtaagtacccgaggcgaagagagctcgctgagccctgattttttgagtgtctttgttccgggagagtttgtgagttgaaagtatctctgctgggctttctgggccgaaaaccgttccgggggagccgccatttgctttcctgttccctagctagctagctagctctctccgcgttgtccggcagcggcacctagaggttgggacttggcattgcatctgatttaatgaacttaagtctgtgaataagcctttgtgttaacgactggtattcggtcacagcatatttagagaaaagacttggagcttaaataaaaactaaggcaaaatanacgcttagctgctgatctacaaaaaaacttntttgtaattaaaagatttcaattcatagccaactggtgttttaaactattgcagta

SEQ ID NO: 215 - DNA, 779 bp, Homo sapiens
  misc_feature (613)..(613): n is a, c, g, or t/u
  misc_feature (622)..(622): n is a, c, g, or t/u
  misc_feature (633)..(633): n is a, c, g, or t/u
  misc_feature (651)..(651): n is a, c, g, or t/u
  misc_feature (657)..(657): n is a, c, g, or t/u
  misc_feature (664)..(664): n is a, c, g, or t/u
  misc_feature (680)..(680): n is a, c, g, or t/u
  misc_feature (698)..(698): n is a, c, g, or t/u
  misc_feature (730)..(730): n is a, c, g, or t/u
ggtaggcgacccggacggagggccggcgaggtgcggggtctggtgatgcgagctgcgcctctcggcaagatttcgcgctgcccatcccgggccctttcatcagtaatcggtagtggatcactctgccaagcggcaggaagaattaaggaaacgacaaggagacgctcggctctctcccgcttggctccttgcggcctcctcttcccttcgctccggcccggtgaaactgaacttataatcgtcactggattgtaagtacccgaggcgaagagagctcgctgagccctgattttttgagtgtctttgttccgggagagtttgtgagttgaaagtatctctgctgggctttctgggccgaaaaccgttccgggggagccgccatttgctttcctgttccctagctagctagctagctctctccgcgttgtccggcagcggcacctaaaggttgggacttggcattgcatctgatttaatgaacttaagtctgtgaataagcctttgtgttaacgactggtattcggtcacagcatatttagagaaaagacttgggagcttaaaataaaaactaaggcaaaatagacgcttagctgctgatctacaagaaaacttnttgtaattnaaaaaatttcnattcataaccaaactggnggtttnaaactanttgcaagtaacttggnactttttaattgtaaccncgcattttttttgggagaagtggaattcccangggaaataaaagatgagttaaaaagccaaagatgaatgcttccttcacc

SEQ ID NO: 216 - DNA, 734 bp, Homo sapiens
  misc_feature (58)..(58): n is a, c, g, or t/u
  misc_feature (60)..(60): n is a, c, g, or t/u
  misc_feature (69)..(69): n is a, c, g, or t/u
  misc_feature (101)..(101): n is a, c, g, or t/u
  misc_feature (106)..(106): n is a, c, g, or t/u
  misc_feature (118)..(118): n is a, c, g, or t/u
  misc_feature (137)..(137): n is a, c, g, or t/u
  misc_feature (140)..(140): n is a, c, g, or t/u
  misc_feature (143)..(143): n is a, c, g, or t/u
  misc_feature (155)..(155): n is a, c, g, or t/u
  misc_feature (191)..(191): n is a, c, g, or t/u
  misc_feature (199)..(199): n is a, c, g, or t/u
  misc_feature (208)..(208): n is a, c, g, or t/u
  misc_feature (220)..(220): n is a, c, g, or t/u
  misc_feature (232)..(232): n is a, c, g, or t/u
  misc_feature (235)..(235): n is a, c, g, or t/u
  misc_feature (245)..(246): n is a, c, g, or t/u
  misc_feature (327)..(327): n is a, c, g, or t/u
  misc_feature (351)..(351): n is a, c, g, or t/u
  misc_feature (366)..(366): n is a, c, g, or t/u
  misc_feature (386)..(386): n is a, c, g, or t/u
  misc_feature (394)..(394): n is a, c, g, or t/u
  misc_feature (396)..(396): n is a, c, g, or t/u
  misc_feature (413)..(413): n is a, c, g, or t/u
  misc_feature (418)..(418): n is a, c, g, or t/u
  misc_feature (427)..(427): n is a, c, g, or t/u
  misc_feature (453)..(453): n is a, c, g, or t/u
  misc_feature (460)..(460): n is a, c, g, or t/u
  misc_feature (480)..(480): n is a, c, g, or t/u
  misc_feature (544)..(544): n is a, c, g, or t/u
  misc_feature (563)..(563): n is a, c, g, or t/u
  misc_feature (597)..(597): n is a, c, g, or t/u
  misc_feature (609)..(609): n is a, c, g, or t/u
  misc_feature (619)..(619): n is a, c, g, or t/u
  misc_feature (635)..(635): n is a, c, g, or t/u
  misc_feature (655)..(655): n is a, c, g, or t/u
  misc_feature (661)..(661): n is a, c, g, or t/u
  misc_feature (689)..(689): n is a, c, g, or t/u
  misc_feature (703)..(703): n is a, c, g, or t/u
aaagggaaaaacagatgcttttatttattggattggaaacaacttaataatttgcatntntacatatanaaagctgctttgaataactgggaaaacaactnttgcntgggaaaacatntgcaaactagcatcattgnctntanactaggttcttnttattgatctcacgtcatcacaaagcagcaacagcngcttttanaaaatgganaaacagtaaagncctgcaatgaanctntaattaaggnngaaccatacattccgctaatcctgcaactttcctacaatcatttttctgcctatacaatcctgcttcttataggatgaacncctagcaaaacaatacaaatttgntgaaaaacaaaattncaaacaaatgaaagaacttnacagaacncncagcattaaaaggactnggaanagcaaggtnttaatacccagtacaataaagccaanaattttntaatgctgaccagtctgaanactgaaattaaatatcagttctttttacttctctagggagggatttctagctcctcttgcaaanagctgagttgctccttttntcgggcttccttttggttgagctcatccaggtancagcctgaaatntgttcttganaagcccaaattttccncttttcatggaaggaaaaanccctcnttggtcggtttttggcccctggtccctngggggtcttttttngggagcctttggcccttttcattggttgggc

SEQ ID NO: 217 - DNA, 766 bp, Homo sapiens
  misc_feature (608)..(608): n is a, c, g, or t/u
  misc_feature (655)..(655): n is a, c, g, or t/u
  misc_feature (686)..(686): n is a, c, g, or t/u
  misc_feature (702)..(702): n is a, c, g, or t/u
ggacggagggccggcgaggtgcggggtctggtgatgcgagctgcgcctctcggcaagatttcgcgctgcccatcccgggccctttcatcagtaatcggtagtggatcactctgccaagcggcaggaagaattaaggaaacgacaaggagacgctcggctctctcccgcttggctccttgcggcctcctcttcccttcgctccggcccggtgaaactgaacttataatcgtcactggattgtaagtacccgaggcgaagagagctcgctgagccctgattttttgagtgtctttgttccgggagagtttgtgagttgaaagtatctctgctgggctttctgggccgaaaaccgttccgggggagccgccatttgctttcctgttccctagctagctagctagctctctccgcgttgtccggcagcggcacctagaggttgggacttggcattgcatctgatttaatgaacttaagtctgtgaataagcctttgtgttaacgactggtattcggtcacagcatatttagagaaaagacttggagcttaaataaaaactaaggcaaaatagacgcttagcttgctgatctacagagaacttcttgtaattnaaaaaattcaattcatagcaaactggtgttttaaactattgcagtancttggaactttttagtgtaaccagcatttanttggagaagtgaatcncaagggaattaaagatgagttaaagccaaagatgatgcttcctcacgaactgggaagaagccag

SEQ ID NO: 218 - DNA, 818 bp, Homo sapiens
  misc_feature (272)..(272): n is a, c, g, or t/u
  misc_feature (277)..(277): n is a, c, g, or t/u
  misc_feature (315)..(315): n is a, c, g, or t/u
  misc_feature (318)..(318): n is a, c, g, or t/u
  misc_feature (327)..(327): n is a, c, g, or t/u
  misc_feature (329)..(329): n is a, c, g, or t/u
  misc_feature (331)..(331): n is a, c, g, or t/u
  misc_feature (333)..(334): n is a, c, g, or t/u
  misc_feature (343)..(343): n is a, c, g, or t/u
  misc_feature (350)..(350): n is a, c, g, or t/u
  misc_feature (369)..(369): n is a, c, g, or t/u
  misc_feature (371)..(371): n is a, c, g, or t/u
  misc_feature (375)..(375): n is a, c, g, or t/u
  misc_feature (379)..(380): n is a, c, g, or t/u
  misc_feature (385)..(386): n is a, c, g, or t/u
  misc_feature (396)..(396): n is a, c, g, or t/u
  misc_feature (399)..(400): n is a, c, g, or t/u
  misc_feature (403)..(404): n is a, c, g, or t/u
  misc_feature (407)..(407): n is a, c, g, or t/u
  misc_feature (427)..(427): n is a, c, g, or t/u
  misc_feature (436)..(436): n is a, c, g, or t/u
  misc_feature (479)..(480): n is a, c, g, or t/u
  misc_feature (508)..(509): n is a, c, g, or t/u
  misc_feature (514)..(514): n is a, c, g, or t/u
  misc_feature (527)..(527): n is a, c, g, or t/u
  misc_feature (534)..(534): n is a, c, g, or t/u
  misc_feature (539)..(539): n is a, c, g, or t/u
  misc_feature (559)..(559): n is a, c, g, or t/u
  misc_feature (565)..(565): n is a, c, g, or t/u
  misc_feature (577)..(577): n is a, c, g, or t/u
  misc_feature (595)..(595): n is a, c, g, or t/u
  misc_feature (597)..(597): n is a, c, g, or t/u
  misc_feature (600)..(600): n is a, c, g, or t/u
  misc_feature (613)..(613): n is a, c, g, or t/u
  misc_feature (628)..(628): n is a, c, g, or t/u
  misc_feature (632)..(632): n is a, c, g, or t/u
  misc_feature (639)..(639): n is a, c, g, or t/u
  misc_feature (642)..(642): n is a, c, g, or t/u
  misc_feature (656)..(656): n is a, c, g, or t/u
  misc_feature (669)..(669): n is a, c, g, or t/u
  misc_feature (677)..(677): n is a, c, g, or t/u
  misc_feature (681)..(681): n is a, c, g, or t/u
  misc_feature (685)..(685): n is a, c, g, or t/u
  misc_feature (703)..(704): n is a, c, g, or t/u
  misc_feature (709)..(709): n is a, c, g, or t/u
  misc_feature (711)..(711): n is a, c, g, or t/u
  misc_feature (721)..(721): n is a, c, g, or t/u
  misc_feature (732)..(732): n is a, c, g, or t/u
  misc_feature (739)..(740): n is a, c, g, or t/u
  misc_feature (745)..(745): n is a, c, g, or t/u
  misc_feature (753)..(753): n is a, c, g, or t/u
  misc_feature (766)..(766): n is a, c, g, or t/u
  misc_feature (797)..(797): n is a, c, g, or t/u
  misc_feature (800)..(800): n is a, c, g, or t/u
  misc_feature (806)..(806): n is a, c, g, or t/u
  misc_feature (816)..(816): n is a, c, g, or t/u
cccggacggagggccggcgaggtgcggggtctggtgatgcgagctgcgcctctcggcaagatttcgcgctgcccatcccgggccctttcatcagtaatcggtagtggatcactctgccaagcggcaggaagaattaaggaaacgacaaggagacgctcggctctctcccgcttggctccttgcggcctcctcttcccttcgctccggcccggtgaaactgaacttataatcgtcactggaatggaaagaccccgaaggcgaaaaaaagctcnttganccctgattttttgagtgtctttgttccgggagagttgnganttgaaagtntntntnnttggctttnttggccnaaaacccgttccggggaancngccnttgnntttcnngttccttacntanntanntanctttttccgcgttgtccggnagcggcacntaaaggttgggactggcattggatttgaattaatgaaactaannctgggaaaaaacccttggggttaccaannggttncggccccagcatntttaaanaaaanacttggatttaataaaaacntaaggngaaaaaaaaccnttactgttgatattaaananaantttttttgaattnaaaaaatttcaattnatancaaactnggngttaaaattttgcnaaaactgggaaantttttagngaancccnccttttttggggaaaagnnattcncngggaaataanatatgttaaancccaaanntgttncttctcanaactggaaaaccngtttattttacgtttgccctcaaaaattccnttntttggnaaagggcaanac

SEQ ID NO: 219 - DNA, 859 bp, Homo sapiens
  misc_feature (516)..(516): n is a, c, g, or t/u
  misc_feature (566)..(566): n is a, c, g, or t/u
  misc_feature (673)..(673): n is a, c, g, or t/u
  misc_feature (729)..(729): n is a, c, g, or t/u
  misc_feature (780)..(780): n is a, c, g, or t/u
  misc_feature (782)..(782): n is a, c, g, or t/u
  misc_feature (789)..(789): n is a, c, g, or t/u
  misc_feature (798)..(798): n is a, c, g, or t/u
  misc_feature (811)..(811): n is a, c, g, or t/u
  misc_feature (814)..(814): n is a, c, g, or t/u
  misc_feature (817)..(817): n is a, c, g, or t/u
  misc_feature (844)..(844): n is a, c, g, or t/u
  misc_feature (851)..(851): n is a, c, g, or t/u
  misc_feature (853)..(853): n is a, c, g, or t/u
  misc_feature (857)..(857): n is a, c, g, or t/u
aaagggaaaaacagatgcttttatttattgtattggaaacaacttaataatttgcatctctacatatagaaagctgctttgaataactgggaaaacaactattgcatgggaaaacatatgcaaactagcatcattgtctctagactaggttcttcttattgatctcacgtcatcacaaagcagcaacagcagcttctagaaaatggagaaacagtaaagtcctgcaatgaagctataattaaggttgaaccatacattccgctaatcctgcaactttcctacaatcatttttctgcctatacaatcctgcttcttataggatgaacacctagcaaaacaatataaatttgctgaaaaacaaaattacaaacaaatgaaagaacttaacagaacacacagcattaaaaggactaggaagagcaaggtcttaatacccagtacaataaagccaagaattttctaatgctgaccagtctgaagactgaaattaaatatcagttctttttacttctctangagtgattctagctcctcttgcaaagagctgagttgctccttttctcggncttccttttggttgagctcatccagtacagcctgaaatctgttcttgagagccagattttccactttcatggatgagatcctcttgtcgtttgcctgtcctgggctnttggagcttgcctttcatgtggcaatctgcttctgaattcccttaccagctggatngggtccttcattttcctggggcggtcatctgatcaattaaacttggcctgnanctggctnttccaaacnttcctccggggcnaanganggttatatcttcttcatcttgaagccnggggctnantttnat

SEQ ID NO: 220 - DNA, 855 bp, Homo sapiens
  misc_feature (5)..(5): n is a, c, g, or t/u
  misc_feature (196)..(196): n is a, c, g, or t/u
  misc_feature (566)..(566): n is a, c, g, or t/u
  misc_feature (577)..(577): n is a, c, g, or t/u
  misc_feature (642)..(642): n is a, c, g, or t/u
  misc_feature (644)..(644): n is a, c, g, or t/u
  misc_feature (648)..(648): n is a, c, g, or t/u
  misc_feature (651)..(651): n is a, c, g, or t/u
  misc_feature (659)..(659): n is a, c, g, or t/u
  misc_feature (731)..(731): n is a, c, g, or t/u
  misc_feature (789)..(789): n is a, c, g, or t/u
  misc_feature (791)..(791): n is a, c, g, or t/u
  misc_feature (793)..(793): n is a, c, g, or t/u
  misc_feature (800)..(800): n is a, c, g, or t/u
  misc_feature (814)..(814): n is a, c, g, or t/u
  misc_feature (831)..(831): n is a, c, g, or t/u
  misc_feature (841)..(841): n is a, c, g, or t/u
aaagngaaaaacagatgcttttatttattgtattggaaacaacttaataatttgcatctctacatatagaaagctgctttgaataactgggaaaacaactattgcatgggaaaacatatgcaaactagcatcattgtctctagactaggttcttcttattgatctcacgtcatcacaaagcagcaacagcagcttntagaaaatggagaaacagtaaagtcctgcaatgaagctataattaaggttgaaccatacattccgctaatcctgcaactttcctacaatcatttttctgcctatacaatcctgcttcttataggatgaacacctagcaaaacaatacaaatttgctgaaaaacaaaattacaaacaaatgaaagaacttaacagaacacacagcattaaaaggactaggaagagcaaggtcttaatacccagtacaataaagccaagaattttctaatgctgaccagtctgaagactgaaattaaatatcagttctttttacttctctaggagtgattctagctcctcttgcaaagagctgagttgctccttttctcggncttccttttgnttgagctcatccagtacagcctgaaatctgttcttgagagccagattttcccctttcatgaaganancctntgncggtttgncctgtcctgggcttttggagcttggctttcatggtggcaatctgcttctgaattcccattaacccgctgatngggtccttctttttcctggggctggtcatctgattcatttaacttggccctggacttngntntccaaanctttctccgggggnaaagaaggttaatttcntttttcaacnttggaggccggggg

SEQ ID NO: 221 - DNA, 881 bp, Homo sapiens
  misc_feature (30)..(30): n is a, c, g, or t/u
  misc_feature (33)..(33): n is a, c, g, or t/u
  misc_feature (57)..(57): n is a, c, g, or t/u
  misc_feature (59)..(59): n is a, c, g, or t/u
  misc_feature (68)..(68): n is a, c, g, or t/u
  misc_feature (100)..(100): n is a, c, g, or t/u
  misc_feature (105)..(105): n is a, c, g, or t/u
  misc_feature (117)..(117): n is a, c, g, or t/u
  misc_feature (136)..(136): n is a, c, g, or t/u
  misc_feature (139)..(139): n is a, c, g, or t/u
  misc_feature (142)..(142): n is a, c, g, or t/u
  misc_feature (154)..(154): n is a, c, g, or t/u
  misc_feature (192)..(192): n is a, c, g, or t/u
  misc_feature (195)..(195): n is a, c, g, or t/u
  misc_feature (203)..(203): n is a, c, g, or t/u
  misc_feature (207)..(207): n is a, c, g, or t/u
  misc_feature (234)..(234): n is a, c, g, or t/u
  misc_feature (244)..(244): n is a, c, g, or t/u
  misc_feature (292)..(292): n is a, c, g, or t/u
  misc_feature (312)..(312): n is a, c, g, or t/u
  misc_feature (326)..(326): n is a, c, g, or t/u
  misc_feature (365)..(365): n is a, c, g, or t/u
  misc_feature (367)..(367): n is a, c, g, or t/u
  misc_feature (393)..(393): n is a, c, g, or t/u
  misc_feature (400)..(400): n is a, c, g, or t/u
  misc_feature (412)..(412): n is a, c, g, or t/u
  misc_feature (425)..(426): n is a, c, g, or t/u
  misc_feature (439)..(439): n is a, c, g, or t/u
  misc_feature (452)..(452): n is a, c, g, or t/u
  misc_feature (459)..(459): n is a, c, g, or t/u
  misc_feature (500)..(500): n is a, c, g, or t/u
  misc_feature (530)..(530): n is a, c, g, or t/u
  misc_feature (574)..(574): n is a, c, g, or t/u
  misc_feature (585)..(585): n is a, c, g, or t/u
  misc_feature (590)..(590): n is a, c, g, or t/u
  misc_feature (618)..(619): n is a, c, g, or t/u
  misc_feature (638)..(638): n is a, c, g, or t/u
  misc_feature (648)..(648): n is a, c, g, or t/u
  misc_feature (666)..(666): n is a, c, g, or t/u
  misc_feature (676)..(676): n is a, c, g, or t/u
  misc_feature (691)..(691): n is a, c, g, or t/u
  misc_feature (703)..(703): n is a, c, g, or t/u
  misc_feature (709)..(709): n is a, c, g, or t/u
  misc_feature (725)..(725): n is a, c, g, or t/u
  misc_feature (727)..(727): n is a, c, g, or t/u
  misc_feature (738)..(738): n is a, c, g, or t/u
  misc_feature (744)..(745): n is a, c, g, or t/u
  misc_feature (747)..(747): n is a, c, g, or t/u
  misc_feature (754)..(754): n is a, c, g, or t/u
  misc_feature (771)..(771): n is a, c, g, or t/u
  misc_feature (781)..(782): n is a, c, g, or t/u
  misc_feature (798)..(798): n is a, c, g, or t/u
  misc_feature (800)..(800): n is a, c, g, or t/u
  misc_feature (802)..(802): n is a, c, g, or t/u
  misc_feature (805)..(805): n is a, c, g, or t/u
  misc_feature (817)..(817): n is a, c, g, or t/u
  misc_feature (824)..(824): n is a, c, g, or t/u
  misc_feature (837)..(837): n is a, c, g, or t/u
  misc_feature (842)..(842): n is a, c, g, or t/u
  misc_feature (851)..(852): n is a, c, g, or t/u
  misc_feature (860)..(860): n is a, c, g, or t/u
  misc_feature (868)..(868): n is a, c, g, or t/u
  misc_feature (874)..(874): n is a, c, g, or t/u
aagggaaaaacagatgcttttatttattgnatnggaaacaacttaataatttgcatntntacatatanaaagctgctttgaataactgggaaaacaactnttgcntgggaaaacatntgcaaactagcatcattgnctntanactaggttcttnttattgatctcacgtcatcacaaagcagcaacagcagnttntaaaaaangganaaacagtaaagtcctgcaatgaagctntaattaaggntgaaccatacattccgctaatcctgcaactttcctacaatcatttttntgcctatacaatcctgcttnttataggatgaacncctagcaaaacaatataaatttgctgaaaaacaaaattncnaacaaatgaaagaacttaacagaacncacagcnttaaaaggactnggaagagcaaggnnttaatacccagtncaataaagccaanaattttntaatgctgaccagtctgaagactgaaattaaatatcagttntttttacttctctaggagtgattctagctnctcttgcaaagagctgagttgctccttttctcgggcttcctttnggttgagctcntccantacagcctgaaaatttgttctttgaaannccaaattttccccctttcntgaaagagancccctttggtccgttttnccctgtcctnggggctttttggaancttgcccttttnatggtngggcaatcctggcttntngaaattcccanaacccnngntggaatnggggtcccttcattttncctgggggcnnggcccatctggaatanantnaancctgggccctgnaaacttngtttttcccaaanttttnccccggggnnaaaggaangggttatntctctnccacttt

SEQ ID NO: 222 - DNA, 719 bp, Homo sapiens
  misc_feature (13)..(13): n is a, c, g, or t/u
  misc_feature (30)..(31): n is a, c, g, or t/u
  misc_feature (33)..(33): n is a, c, g, or t/u
  misc_feature (57)..(57): n is a, c, g, or t/u
  misc_feature (59)..(59): n is a, c, g, or t/u
  misc_feature (68)..(68): n is a, c, g, or t/u
  misc_feature (76)..(76): n is a, c, g, or t/u
  misc_feature (87)..(87): n is a, c, g, or t/u
  misc_feature (100)..(100): n is a, c, g, or t/u
  misc_feature (105)..(105): n is a, c, g, or t/u
  misc_feature (117)..(117): n is a, c, g, or t/u
  misc_feature (121)..(121): n is a, c, g, or t/u
  misc_feature (127)..(127): n is a, c, g, or t/u
  misc_feature (136)..(136): n is a, c, g, or t/u
  misc_feature (139)..(139): n is a, c, g, or t/u
  misc_feature (142)..(142): n is a, c, g, or t/u
  misc_feature (149)..(149): n is a, c, g, or t/u
  misc_feature (151)..(151): n is a, c, g, or t/u
  misc_feature (154)..(154): n is a, c, g, or t/u
  misc_feature (166)..(166): n is a, c, g, or t/u
  misc_feature (171)..(171): n is a, c, g, or t/u
  misc_feature (174)..(174): n is a, c, g, or t/u
  misc_feature (185)..(185): n is a, c, g, or t/u
  misc_feature (187)..(187): n is a, c, g, or t/u
  misc_feature (190)..(190): n is a, c, g, or t/u
  misc_feature (203)..(203): n is a, c, g, or t/u
  misc_feature (206)..(207): n is a, c, g, or t/u
  misc_feature (219)..(219): n is a, c, g, or t/u
  misc_feature (231)..(231): n is a, c, g, or t/u
  misc_feature (244)..(244): n is a, c, g, or t/u
  misc_feature (292)..(292): n is a, c, g, or t/u
  misc_feature (315)..(315): n is a, c, g, or t/u
  misc_feature (317)..(317): n is a, c, g, or t/u
  misc_feature (326)..(326): n is a, c, g, or t/u
  misc_feature (330)..(331): n is a, c, g, or t/u
  misc_feature (350)..(350): n is a, c, g, or t/u
  misc_feature (362)..(362): n is a, c, g, or t/u
  misc_feature (367)..(367): n is a, c, g, or t/u
  misc_feature (369)..(369): n is a, c, g, or t/u
  misc_feature (371)..(371): n is a, c, g, or t/u
  misc_feature (388)..(388): n is a, c, g, or t/u
  misc_feature (391)..(391): n is a, c, g, or t/u
  misc_feature (397)..(397): n is a, c, g, or t/u
  misc_feature (417)..(417): n is a, c, g, or t/u
  misc_feature (419)..(419): n is a, c, g, or t/u
  misc_feature (426)..(426): n is a, c, g, or t/u
  misc_feature (432)..(432): n is a, c, g, or t/u
  misc_feature (468)..(468): n is a, c, g, or t/u
  misc_feature (476)..(476): n is a, c, g, or t/u
  misc_feature (493)..(493): n is a, c, g, or t/u
  misc_feature (519)..(519): n is a, c, g, or t/u
  misc_feature (525)..(525): n is a, c, g, or t/u
  misc_feature (530)..(530): n is a, c, g, or t/u
  misc_feature (542)..(542): n is a, c, g, or t/u
  misc_feature (577)..(577): n is a, c, g, or t/u
  misc_feature (579)..(579): n is a, c, g, or t/u
  misc_feature (588)..(588): n is a, c, g, or t/u
  misc_feature (608)..(608): n is a, c, g, or t/u
  misc_feature (613)..(613): n is a, c, g, or t/u
  misc_feature (623)..(623): n is a, c, g, or t/u
  misc_feature (627)..(627): n is a, c, g, or t/u
  misc_feature (671)..(671): n is a, c, g, or t/u
  misc_feature (681)..(681): n is a, c, g, or t/u
aagggaaaaacanatgcttttatttattgnntnggaaacaacttaataatttgcatntntacatatanaaagctgntttgaataacngggaaaacaactnttgcntgggaaaacatntgcnaactancatcattgnctntanactaggntnttnttattgatctcncgtcntcncaaagcagcancngcngcttttaaaaaanggnnaaacagtaaagncctgcaatgaanctttaattaaggntgaaccatacattccgctaatcctgcaactttcctacaatcatttttntgcctatacaatcctgctttttntnggatgaacncctnncaaaacaatttaaatttgntgaaaaacaaanttccnancnaatgaaagaacttaacngancccccngctttaaaaggactaggaanancaaggtnttaatncccagtccaataaagccaaaaattttttaatgctgncccgtctnaaaactgaaattaaatntcaggtctttttacttctctaggagnggattntagcncctcttgcaaanagctgagttgccccttttctcgggcttccttttgntngagctcatnccagtacagccctggaaatntgttnttgaaaaccnaaantttccccctttcatggaaagaaaaaccccttgggcggtttttgnccctggcccnggggctttttgggaacctggcccttttaatgggggggc

SEQ ID NO: 223 - DNA, 799 bp, Homo sapiens
  misc_feature (618)..(618): n is a, c, g, or t/u
  misc_feature (622)..(622): n is a, c, g, or t/u
  misc_feature (628)..(628): n is a, c, g, or t/u
  misc_feature (646)..(646): n is a, c, g, or t/u
  misc_feature (688)..(688): n is a, c, g, or t/u
  misc_feature (702)..(702): n is a, c, g, or t/u
  misc_feature (708)..(708): n is a, c, g, or t/u
  misc_feature (732)..(732): n is a, c, g, or t/u
actgtggcttctgcatttcaaatcagcacttgcagggagacaacggggtttttgaatagtatcacctggtatgaaaagttttcccaagaaaccacaaacgattgttcattttttctccttttttgttaactttttgccacactcaagtcagtttaagtcctagcaaaaagacggtagttaggataccactgtggctgtagatgatgtgacactggttgaatttgtgctggcgtttgtgtaacttccctcgctgtttgtgtttgattcgttagggggcacctggcttgaattggctcgaaggattgctcctgctgcactgcaatgtggccgcggccctggttctggtgtgtaggtaaaggtaaggctggtggaataaatgattccatcatttcggaccaaagttactggaacctggactggttgccggacccatctccaaccttctcggaatgcagaaatgtctgggacgacacagagcatactctctccacacctgtacatagtttcagcttctacatccccaaaccacactcgtaaatttggagtgaaattctgtcctgtaagttcaagcattgctacgtccccacccgccattcaactgaaggctctctaccacangccncaggantgactggggcaaggacanggcccattcccttcataaaatgtatactctggccttatctgngcctaatgaattgncccagnaagcgccatcattttaatcaatcncttttaattgggtccttttgggaacatggaagtgggccctgaaaattggaattatttctttctttga

SEQ ID NO: 224 - DNA, 852 bp, Homo sapiens
  misc_feature (618)..(618): n is a, c, g, or t/u
  misc_feature (641)..(641): n is a, c, g, or t/u
  misc_feature (647)..(647): n is a, c, g, or t/u
  misc_feature (693)..(693): n is a, c, g, or t/u
  misc_feature (738)..(738): n is a, c, g, or t/u
  misc_feature (745)..(745): n is a, c, g, or t/u
  misc_feature (758)..(758): n is a, c, g, or t/u
  misc_feature (772)..(772): n is a, c, g, or t/u
  misc_feature (789)..(789): n is a, c, g, or t/u
  misc_feature (803)..(803): n is a, c, g, or t/u
  misc_feature (814)..(814): n is a, c, g, or t/u
  misc_feature (841)..(841): n is a, c, g, or t/u
actgtggcttctgcatttcaaatcagcacttgcagggagacaacggggtttttgaatagtatcacctggtatgaaaagttttcccaagaaaccacaaacgattgttcattttttctccttttttgttaactttttgccacactcaagtcagtttaagtcctagcaaaaagacggtagttaggataccactgtggctgtagatgatgtgacactggttgaatttgtgctggcgtttgtgtaacttccctcgctgtttgtgtttgattcgttagggggcacctggcttgaattggctcgaaggattgctcctgctgcactgcaatgtggccgcggccctggttctggtgtgtaggtaaaggtaaggctggtggaataaatgattccatcatttcggaccaaagttactggaacctggactggttgccggacccatctccaaccttctcggaatgcagaaatgtctgggacgacacagagcatactctctccacacctgtacatagtttcagcttctacatccccaaaccacactcgtaaatttggagtgaaattctgtcctgtaagttcaagcattgctacgtccccacccgccattcaactgaaggctctctaccacangcaccaggaatgactggggcaanggacanggccccattccctcataaaaatggtatacctcttgccttatctggngcttaatgattggcccaaggaagcgcccatcaattaatcaatccnctttaanttgggtccttttnggacaatgggagtngggccctggaaaattgnaattatttcttttntttgagaaaanggcccaaaaataccattccttttctgnattccccttaa

SEQ ID NO: 225 - DNA, 710 bp, Homo sapiens
  misc_feature (552)..(552): n is a, c, g, or t/u
  misc_feature (561)..(561): n is a, c, g, or t/u
  misc_feature (574)..(574): n is a, c, g, or t/u
  misc_feature (639)..(639): n is a, c, g, or t/u
  misc_feature (675)..(675): n is a, c, g, or t/u
gttaactttttgccacactcaagtcagtttaagtcctagcaaaaagacggtagttaggataccactgtggctgtagatgatgtgacactggttgaatttgtgctggcgtttgtgtaacttccctcgctgtttgtgtttgattcgttagggggcacctggcttgaattggctcgaaggattgctcctgctgcactgcaatgtggccgcggccctggttctggtgtgtaggtaaaggtaaggctggtggaataaatgattccatcatttcggaccaaagttactggaacctggactggttgccggacccatctccaaccttctcggaatgcagaaatgtctgggacgacacagagcatactctctccacacctgtacatagtttcagcttctacatccccaaaccacactcgtaaatttggagtgaaattctgtcctgtaagttcaagcattgctacgtccccaccgccattcaactgaaggctctctaccacaggcacaggagtgactggggcaaggacagggcccattccctcataaaatgtatactcttgncttatctgngctaatgaattgnccaggaagcgcccatcatttatcatctctttatttgggtctttttggacatgggagtgggcctgnaaattggaaatattcttttttttggagaaaagggcncaaataccattttctttttctgggaatcccttaaa

SEQ ID NO: 226 - DNA, 686 bp, Homo sapiens
  misc_feature (139)..(139): n is a, c, g, or t/u
  misc_feature (141)..(141): n is a, c, g, or t/u
  misc_feature (163)..(163): n is a, c, g, or t/u
  misc_feature (188)..(188): n is a, c, g, or t/u
  misc_feature (192)..(192): n is a, c, g, or t/u
  misc_feature (200)..(200): n is a, c, g, or t/u
  misc_feature (211)..(211): n is a, c, g, or t/u
  misc_feature (237)..(237): n is a, c, g, or t/u
  misc_feature (258)..(258): n is a, c, g, or t/u
  misc_feature (278)..(278): n is a, c, g, or t/u
  misc_feature (434)..(434): n is a, c, g, or t/u
  misc_feature (444)..(444): n is a, c, g, or t/u
  misc_feature (462)..(462): n is a, c, g, or t/u
  misc_feature (476)..(476): n is a, c, g, or t/u
  misc_feature (488)..(488): n is a, c, g, or t/u
  misc_feature (516)..(516): n is a, c, g, or t/u
  misc_feature (518)..(518): n is a, c, g, or t/u
  misc_feature (538)..(538): n is a, c, g, or t/u
  misc_feature (581)..(581): n is a, c, g, or t/u
  misc_feature (614)..(614): n is a, c, g, or t/u
  misc_feature (622)..(622): n is a, c, g, or t/u
  misc_feature (649)..(649): n is a, c, g, or t/u
actggggcttctgcatttcaaatcagcacttgcagggagacaacggggtttttgaatagtatcacctggtatgaaaagttttcccaagaaaccacaaacgattgttcattttttctccttttttgttaactttttgccncnctcaagtcagtttaagtcctancaaaaagacggtagttaggataccnctgnggctgtanatgatgtgacnctggttgaatttgtgctggcgtttgngtaacttccctcgctgtttgngtttgattcgttagggggcncctggcttgaattggctcgaaggattgctcctgctgcactgcaatgtggccgcggccctggttctggtgtgtaggtaaaggtaaggctggtggaataaatgattccatcatttcggaccaaagttactggaacctggactggttgccggacccatntccaaccttntcggaatgcaaaaatgtntgggacgacacaanagcatacttttntccacacctgtacatagtttcaagcttntncatccccaaaccacacttcntaaatttggagtgaaattctgtcctgtaagttcaagcatttgntacgtccccacccgccatttaaacttgaaaggntttttttnccccaaggccccaaggaagtggacctnggggccaaaggaccaaggggccccattttcccctcaa

SEQ ID NO: 227 - DNA, 722 bp, Homo sapiens
  misc_feature (88)..(88): n is a, c, g, or t/u
  misc_feature (139)..(139): n is a, c, g, or t/u
  misc_feature (192)..(192): n is a, c, g, or t/u
  misc_feature (200)..(200): n is a, c, g, or t/u
  misc_feature (258)..(258): n is a, c, g, or t/u
  misc_feature (278)..(278): n is a, c, g, or t/u
  misc_feature (444)..(444): n is a, c, g, or t/u
  misc_feature (484)..(484): n is a, c, g, or t/u
  misc_feature (486)..(486): n is a, c, g, or t/u
  misc_feature (513)..(513): n is a, c, g, or t/u
  misc_feature (543)..(543): n is a, c, g, or t/u
  misc_feature (589)..(589): n is a, c, g, or t/u
  misc_feature (600)..(600): n is a, c, g, or t/u
  misc_feature (611)..(611): n is a, c, g, or t/u
  misc_feature (614)..(614): n is a, c, g, or t/u
  misc_feature (622)..(622): n is a, c, g, or t/u
  misc_feature (632)..(632): n is a, c, g, or t/u
  misc_feature (659)..(659): n is a, c, g, or t/u
  misc_feature (679)..(679): n is a, c, g, or t/u
  misc_feature (685)..(685): n is a, c, g, or t/u
actggggcttctgcatttcaaatcagcacttgcagggagacaacggggtttttgaatagtatcacctggtatgaaaagttttcccaanaaaccacaaacgattgttcattttttctccttttttgttaactttttgccncactcaagtcagtttaagtcctagcaaaaagacggtagttaggataccactgnggctgtanatgatgtgacactggttgaatttgtgctggcgtttgtgtaacttccctcgctgtttgngtttgattcgttagggggcncctggcttgaattggctcgaagggttgctcctgctgcactgcaatgtggccgcggccctggttctggtgtgtaggtaaaggtaaggctggtggaataaatgattccatcatttcggaccaaagttactggaacctggactggttgccggacccatttccaaccttntcggaatgcaaaaatgtctgggacgacacaaagcatactntntccacacctgtacatagtttcagcttntacatccccaaaccacactcgtaaaatttngagtgaaaattctgtccttgtaagttcaagcattgctacgtccccncccgccatttnaactggaaggnttnttttaccncaaggcccangaaatgaacttgggggcaaaggaccangggccccatttccctcaatnaaaaangtattacctcttggcccttatttttgggggcctaaaa

SEQ ID NO: 228 - DNA, 819 bp, Homo sapiens
  misc_feature (607)..(607): n is a, c, g, or t/u
  misc_feature (653)..(653): n is a, c, g, or t/u
  misc_feature (712)..(712): n is a, c, g, or t/u
  misc_feature (783)..(783): n is a, c, g, or t/u
  misc_feature (789)..(789): n is a, c, g, or t/u
ccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttnctggacaatcattagcacagataaggcagagtatacattttatganggaatgggccctgtccttgccccaatcactcctgtgcctgtggtaaaaaaagccttcanttgaatggcgggggggacgtaaccaatgcttggaaccttacaggaacaaaatttcacttccaaaatttacnaatggngggtttgggggatgtaaaaaccttgaaact

SEQ ID NO: 229 - DNA, 797 bp, Homo sapiens
  misc_feature (515)..(515): n is a, c, g, or t/u
  misc_feature (560)..(560): n is a, c, g, or t/u
  misc_feature (670)..(670): n is a, c, g, or t/u
  misc_feature (678)..(678): n is a, c, g, or t/u
  misc_feature (703)..(703): n is a, c, g, or t/u
  misc_feature (715)..(716): n is a, c, g, or t/u
  misc_feature (727)..(727): n is a, c, g, or t/u
  misc_feature (736)..(736): n is a, c, g, or t/u
  misc_feature (759)..(759): n is a, c, g, or t/u
gttaactttttgccacactcaagtcagtttaagtcctagcaaaaagacggtagttaggataccactgtggctgtagatgatgtgacactggttgaatttgtgctggcgtttgtgtaacttccctcgctgtttgtgtttgattcgttagggggcacctggcttgaattggctcgaaggattgctcctgctgcactgcaatgtggccgcggccctggttctggtgtgtaggtaaaggtaaggctggtggaataaatgattccatcatttcggaccaaagttactggaacctggactggttgccggacccatctccaaccttctcggaatgcagaaatgtctgggacgacacagagcatactctctccacacctgtacatagtttcagcttctacatccccaaaccacactcgtaaatttggagtgaaattctgtcctgtaagttcaagcattgctacgtccccaccgccattcaactgaaggctctctaccacaggcacaggagtgactggggcaangacagggcccattccctcataaaatgtatactctgccttatctgngctaatgaatggccaggaagcgccatcatttaatcatctcttttatttgggtctttttggacattgggaggtggcctggaaaatttggaattatttttttttttttgaanaaaaggcncaaaataccattcttttctgggatncccttaaagggnnaaaaaaggccnccatttttnttgggagtttggtggaacacaanggattcattttggcatttcccaaaaaatggccgggcct

SEQ ID NO: 230 - DNA, 779 bp, Homo sapiens
  misc_feature (611)..(611): n is a, c, g, or t/u
  misc_feature (625)..(625): n is a, c, g, or t/u
  misc_feature (670)..(670): n is a, c, g, or t/u
  misc_feature (713)..(713): n is a, c, g, or t/u
  misc_feature (746)..(746): n is a, c, g, or t/u
  misc_feature (759)..(759): n is a, c, g, or t/u
actgtggcttctgcatttcaaatcagcacttgcagggagacaacggggtttttgaatagtatcacctggtatgaaaagttttcccaagaaaccacaaacgattgttcattttttctccttttttgttaactttttgccacactcaagtcagtttaagtcctagcaaaaagacggtagttaggataccactgtggctgtagacgatgtgacactggttgaatttgtgctggcgtttgtgtaacttccctcgctgtttgtgtttgattcgttagggggcacctggcttgaattggctcgaaggattgctcctgctgcactgcaatgtggccgcggccctggttctggtgtgtaggtaaaggtaaggctggtggaataaatgattccatcatttcggaccaaagttactggaacctggactggttgccggacccatctccaaccttctcggaatgcagaaatgtctgggacgacacagagcatactctctccacacctgtacatagtttcagcttctacatccccaaaccacactcgtaaatttggagtgaaattctgtcctgtaagttcaagcattgctaccgtccccacccgccattcaactgaaggctctntaccacaggcacangaatgactggggcaaggacaggggcccattccctcataaaaatgnatactctggcctattctgggctaatgattggcccaggaaaccncatcatttatcatctctttatttgggtcttttnggacatgggaagnggcctgaaattgaaatattt

SEQ ID NO: 231 - DNA, 786 bp, Homo sapiens
  misc_feature (455)..(455): n is a, c, g, or t/u
  misc_feature (557)..(557): n is a, c, g, or t/u
  misc_feature (592)..(592): n is a, c, g, or t/u
  misc_feature (607)..(607): n is a, c, g, or t/u
  misc_feature (609)..(609): n is a, c, g, or t/u
  misc_feature (611)..(611): n is a, c, g, or t/u
  misc_feature (646)..(646): n is a, c, g, or t/u
  misc_feature (649)..(649): n is a, c, g, or t/u
  misc_feature (668)..(668): n is a, c, g, or t/u
  misc_feature (680)..(680): n is a, c, g, or t/u
  misc_feature (687)..(687): n is a, c, g, or t/u
  misc_feature (710)..(710): n is a, c, g, or t/u
  misc_feature (746)..(746): n is a, c, g, or t/u
  misc_feature (752)..(752): n is a, c, g, or t/u
  misc_feature (764)..(764): n is a, c, g, or t/u
  misc_feature (778)..(778): n is a, c, g, or t/u
  misc_feature (782)..(782): n is a, c, g, or t/u
actggggcttctgcatttcaaatcagcacttgcagggagacaacggggtttttgaatagtatcacctggtatgaaaagttttcccaagaaaccacaaacgattgttcattttttctccttttttgttaactttttgccacactcaagtcagtttaagtcctagcaaaaagacggtagttaggataccactgtggctgtagatgatgtgacactggttgaatttgtgctggcgtttgtgtaacttccctcgctgtttgtgtttgattcgttagggggcacctggcttgaattggctcgaaggattgctcctgctgcactgcaatgtggccgcggccctggttctggtgtgtaggtaaaggtaaggctggtggaataaatgattccatcatttcggaccaaagttactggaacctggactggttgccggacccatctccaaccttctcggaatgcanaaatgtctgggacgacacagagcatactctctccacacctgtacatagtttcagcttctacatccccaaaccacactcgtaaatttggagtgaaattctgtnctgtaaagttcaagcattgctacgtccccacccgncattcaactgaaggntntntaccacaggcacaggaatgactggggcaaggacanggnccattcccttataaaaagnatacctctgccntatctgngctaatgattggccaagaaaccnccatcatttaatcatctctttattttgggtcttttngacatngagggggcttgnaaattgaattattntttnttga

SEQ ID NO: 232 - DNA, 785 bp, Homo sapiens
  misc_feature (179)..(179): n is a, c, g, or t/u
  misc_feature (208)..(208): n is a, c, g, or t/u
  misc_feature (216)..(216): n is a, c, g, or t/u
  misc_feature (241)..(241): n is a, c, g, or t/u
  misc_feature (253)..(253): n is a, c, g, or t/u
  misc_feature (294)..(294): n is a, c, g, or t/u
  misc_feature (460)..(460): n is a, c, g, or t/u
  misc_feature (502)..(502): n is a, c, g, or t/u
  misc_feature (513)..(513): n is a, c, g, or t/u
  misc_feature (531)..(531): n is a, c, g, or t/u
  misc_feature (622)..(622): n is a, c, g, or t/u
  misc_feature (624)..(624): n is a, c, g, or t/u
  misc_feature (626)..(626): n is a, c, g, or t/u
  misc_feature (636)..(636): n is a, c, g, or t/u
  misc_feature (642)..(642): n is a, c, g, or t/u
  misc_feature (645)..(645): n is a, c, g, or t/u
  misc_feature (663)..(663): n is a, c, g, or t/u
  misc_feature (666)..(666): n is a, c, g, or t/u
  misc_feature (678)..(678): n is a, c, g, or t/u
  misc_feature (695)..(695): n is a, c, g, or t/u
  misc_feature (706)..(706): n is a, c, g, or t/u
  misc_feature (711)..(711): n is a, c, g, or t/u
  misc_feature (719)..(719): n is a, c, g, or t/u
  misc_feature (724)..(724): n is a, c, g, or t/u
  misc_feature (740)..(740): n is a, c, g, or t/u
  misc_feature (775)..(775): n is a, c, g, or t/u
  misc_feature (780)..(780): n is a, c, g, or t/u
ctttttttttttttttactggggcttctgcatttcaaatcagcacttgcagggagacaacggggtttttgaatagtatcacctggtatgaaaagttttcccaagaaaccacaaacgattgttcattttttctccttttttgttaactttttgccacactcaagtcagtttaagtcctancaaaaagacggtagttaggataccactgnggctgtanatgatgtgacactggttgaatttgngctggcgtttgngtaacttccctcgctgtttgtgtttgattcgttagggggcncctggcttgaattggctcgaaggattgctcctgctgcactgcaatgtggccgcggccctggttctggtgtgtaggtaaaggtaaggctggtggaataaatgattccatcatttcggaccaaagttactggaacctggactggttgccggacccatctccaaccttntcggaatgcaaaaatgtctgggacgacacaaagcatactctntccacacctgnacataagtttcaagcttntacatccccaaaccacactcgtaaatttggagtgaaattctgtcctgtaagttcaaagcattggtacgtccccaccgccattcaactgaangntnttttccacangcccangantgactggggcaaggacanggnccattccttatnaaaaggatactctggcntatctgggctnaagantggccagnaagcncctcatttatcaactntttatttgggtcttttggaaattggaggggcccgnaattnaatta

SEQ ID NO: 233 - DNA, 842 bp, Homo sapiens
  misc_feature (104)..(104): n is a, c, g, or t/u
  misc_feature (208)..(208): n is a, c, g, or t/u
  misc_feature (216)..(216): n is a, c, g, or t/u
  misc_feature (253)..(253): n is a, c, g, or t/u
  misc_feature (460)..(460): n is a, c, g, or t/u
  misc_feature (471)..(471): n is a, c, g, or t/u
  misc_feature (491)..(491): n is a, c, g, or t/u
  misc_feature (502)..(502): n is a, c, g, or t/u
  misc_feature (529)..(529): n is a, c, g, or t/u
  misc_feature (569)..(569): n is a, c, g, or t/u
  misc_feature (619)..(619): n is a, c, g, or t/u
  misc_feature (621)..(621): n is a, c, g, or t/u
  misc_feature (655)..(655): n is a, c, g, or t/u
  misc_feature (661)..(661): n is a, c, g, or t/u
  misc_feature (678)..(678): n is a, c, g, or t/u
  misc_feature (685)..(685): n is a, c, g, or t/u
  misc_feature (708)..(708): n is a, c, g, or t/u
  misc_feature (730)..(730): n is a, c, g, or t/u
  misc_feature (744)..(744): n is a, c, g, or t/u
  misc_feature (765)..(765): n is a, c, g, or t/u
  misc_feature (787)..(787): n is a, c, g, or t/u
  misc_feature (795)..(795): n is a, c, g, or t/u
  misc_feature (806)..(806): n is a, c, g, or t/u
  misc_feature (812)..(812): n is a, c, g, or t/u
  misc_feature (814)..(814): n is a, c, g, or t/u
  misc_feature (821)..(821): n is a, c, g, or t/u
  misc_feature (825)..(825): n is a, c, g, or t/u
  misc_feature (834)..(834): n is a, c, g, or t/u
ctttttttttttttttactggggcttctgcatttcaaatcagcacttgcagggagacaacggggtttttgaatagtatcacctggtatgaaaagttttcccaanaaaccacaaacgattgttcattttttctccttttttgttaactttttgccacactcaagtcagtttaagtcctagcaaaaagacggtagttaggataccactgnggctgtanatgatgtgacactggttgaatttgtgctggcgtttgngtaacttccctcgctgtttgtgtttgattcgttagggggcacctggcttgaattggctcgaaggattgctcctgctgcactgcaatgtggccgcggccctggttctggtgtgtaggtaaaggtaaggctggtggaataaatgattccatcatttcggaccaaagttactggaacctggactggttgccggacccatctccaaccttntcggaatgcanaaatgtctgggacgacacanagcatactctntccacacctgtacatagtttcagcttntacatccccaaaccacactcgtaaatttggagtgaaattntgtcctgtaagttcaagcattggtacgtccccaccgccattcaactgaangnttttttccacaggcacaagaatgactggggcaanggacanggcccatttccctcatnaaaaagnatactctggccttatttgggctnatgaatggccaagaaacccccncatttatcaatctntttatttgggtcttttggganatggagggggcctggaaaatgnaattattntttttttgganaaaagncncaaaaanattnttttttgtnttccttaa

SEQ ID NO: 234 - DNA, 871 bp, Homo sapiens
  misc_feature (119)..(119): n is a, c, g, or t/u
  misc_feature (121)..(121): n is a, c, g, or t/u
  misc_feature (208)..(208): n is a, c, g, or t/u
  misc_feature (216)..(216): n is a, c, g, or t/u
  misc_feature (253)..(253): n is a, c, g, or t/u
  misc_feature (294)..(294): n is a, c, g, or t/u
  misc_feature (358)..(358): n is a, c, g, or t/u
  misc_feature (385)..(385): n is a, c, g, or t/u
  misc_feature (460)..(460): n is a, c, g, or t/u
  misc_feature (471)..(471): n is a, c, g, or t/u
  misc_feature (478)..(478): n is a, c, g, or t/u
  misc_feature (491)..(491): n is a, c, g, or t/u
  misc_feature (502)..(502): n is a, c, g, or t/u
  misc_feature (574)..(574): n is a, c, g, or t/u
  misc_feature (593)..(593): n is a, c, g, or t/u
  misc_feature (621)..(621): n is a, c, g, or t/u
  misc_feature (632)..(632): n is a, c, g, or t/u
  misc_feature (654)..(654): n is a, c, g, or t/u
  misc_feature (659)..(659): n is a, c, g, or t/u
  misc_feature (668)..(668): n is a, c, g, or t/u
  misc_feature (675)..(675): n is a, c, g, or t/u
  misc_feature (723)..(723): n is a, c, g, or t/u
  misc_feature (726)..(726): n is a, c, g, or t/u
  misc_feature (739)..(739): n is a, c, g, or t/u
  misc_feature (762)..(762): n is a, c, g, or t/u
  misc_feature (771)..(771): n is a, c, g, or t/u
  misc_feature (773)..(773): n is a, c, g, or t/u
  misc_feature (797)..(797): n is a, c, g, or t/u
  misc_feature (822)..(822): n is a, c, g, or t/u
  misc_feature (824)..(824): n is a, c, g, or t/u
  misc_feature (843)..(843): n is a, c, g, or t/u
ctttttttttttttttactggggcttctgcatttcaaatcagcacttgcagggagacaacggggtttttgaatagtatcacctggtatgaaaagttttcccaagaaaccacaaacgatngntcattttttctccttttttgttaactttttgccacactcaagtcagtttaagtcctagcaaaaagacggtagttaggataccactgnggctgtanatgatgtgacactggttgaatttgtgctggcgtttgngtaacttccctcgctgtttgtgtttgattcgttagggggcncctggcttgaattggctcgaaggattgctcctgctgcactgcaatgtggccgcggccctggttntggtgtgtaggtaaaggtaaggctggnggaataaatgattccatcatttcggaccaaagttactggaacctggactggttgccggacccatctccaaccttntcggaatgcanaaatgtntgggacgacacanagcatactctntccacacctgtacataagtttcagcttttacatccccaaaccacactcgtaaatttggagtgaaattctgtnctgtaagttcaaacattgntacgtccccccgccattcaactgaaggnttttttcccangcccaggaatgactggggcaanggcanggcccattnccttatnaaaaggatactctggccttatctgggctaaagaattggccagaaagcnccnccatttataactntttatttgggtcttttggacatnggagggccngnaaattgaaattttttttttttganaaaagggacaaaaaaattttttttngnttccttaaggggaaaaggnccctttttgggggtgggacccaaggaac

SEQ ID NO: 235 - DNA, 833 bp, Homo sapiens
  misc_feature (409)..(409): n is a, c, g, or t/u
  misc_feature (704)..(704): n is a, c, g, or t/u
  misc_feature (735)..(735): n is a, c, g, or t/u
  misc_feature (743)..(743): n is a, c, g, or t/u
  misc_feature (748)..(748): n is a, c, g, or t/u
  misc_feature (770)..(770): n is a, c, g, or t/u
ccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaattgacttaaaagataaatacaaaaacattggagctaaacttgttcaagatgttgccaataacacaaatgaagaagctggggatggcactaccactgctactgtactggcacgctctatagccaaggaaggcttcgagaagattagcaaaggtgctaatccagtggaaatcangagaggtgtgatgttagctgttgatgctgtaattgctgaacttaaaaagcagtctaaacctgtgaccacccctgaagaaattgcacaggttgctacgatttctgcaaacggagacaaagaaattggcaatatcatctctgatgcaatgaaaaaagttggaagaaagggtgtcatcacagtaaaggatggaaaaacactgaatgatgaattagaaattattgaaggcatgaagtttgatcgaggctatatttctccatactttattaatacatcaaaagggcagaaatgtgaattncaggatgcctatgttctggtgagtgaaaaanaaaatttntagtntccagtccattgtacctgcttnttgaaattgccaatgcttcacccgtaagccctttggtcattaatcccttgaaaaaagtttgat

SEQ ID NO: 236 - DNA, 753 bp, Homo sapiens
  misc_feature (556)..(556): n is a, c, g, or t/u
  misc_feature (659)..(659): n is a, c, g, or t/u
  misc_feature (714)..(714): n is a, c, g, or t/u
tctctactttgtacacaattattctcactctccacagaaaggctgcttaacttctcatctggtggtggcaagcactaaaatcctgattttaacagaatagtagtaaaaatgcctcagtgatttaagttgaaagcagtacactggtacatggctcttgtacccagtatcaggaatgtacaaatgttttttattcaaaaataaactttaaacaaatttttattacacaaaggttgtcacataattggatactcaaaataaattatctgtaggcatggacaatgacagcagtaaaccattatatattttgtcaactgaaaccagtaactgatggttatagtgattttcagccagcctttttcttcattttctccaactgacttctctgaagttattggtgaggaacactgccttgggcttcctgtcacagttcattaataaaggtaaagcactagtctaggagttagaacatgccacctcccataccacctcccattccacccattgcacccattccagggtccttctcttctttaggaatttctgtgactacaacttntgctgtagttaacagagaggccacaccagcagcatccaataaagcagttctcacaacctttggtgggtcaaatgatcctttttccccatattcacaaaatctncagcccttagcatcataaccaactttttggaggaacttttgcataatttttcttnaacttttcaaaagatccttcaacaccctgcatttcttta

SEQ ID NO: 237 - DNA, 704 bp, Homo sapiens
  misc_feature (626)..(626): n is a, c, g, or t/u
  misc_feature (650)..(650): n is a, c, g, or t/u
gtctcgccgagcgcacgccttgccgccgccccgcagaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaattgacttaaaagataaatacaaaaacattggagctaaacttgttcaagatgttgccaataacacaaatgaagaagctggggatggcactaccactgctactgtactggcacgctctatagccaaggaaggcttcgagaagattagcaaaggtgctaatccagtggaaatcaggagaggtgtgatgttagctgttgatgctgtaattgctgaacttaaaaagcagtctaaacctgtgaccacccctgaagaaattgcacaggttgctacgatttctgcaaacggagacaaagaaattggcaatatcatctctgatgcaatgaaaaaagttggaagaaanggtgtcatccagtaaaaggatggnaaaaccctgaatggatgaattagaaaatttttgaaggcattaaattttgatcca

SEQ ID NO: 238 - DNA, 853 bp, Homo sapiens
  misc_feature (661)..(661): n is a, c, g, or t/u
  misc_feature (668)..(668): n is a, c, g, or t/u
  misc_feature (740)..(740): n is a, c, g, or t/u
  misc_feature (747)..(747): n is a, c, g, or t/u
  misc_feature (751)..(751): n is a, c, g, or t/u
  misc_feature (785)..(785): n is a, c, g, or t/u
  misc_feature (789)..(789): n is a, c, g, or t/u
  misc_feature (799)..(799): n is a, c, g, or t/u
  misc_feature (803)..(803): n is a, c, g, or t/u
  misc_feature (809)..(809): n is a, c, g, or t/u
  misc_feature (816)..(816): n is a, c, g, or t/u
aactttaaacaaatttttattacacaaaggttgtcacataattggatacttctctactttgtacacaattattctcactctccacagaaaggctgcttaacttctcatctggtggtggcaagcactaaaatcctgattttaacagaatagtagtaaaaatgcctcagtgatttaagttgaaagcagtacactggtacatggctcttgtacccagtatcaggaatgtacaaatgttttttattcaaaaatacaaaataaattatctgtaggcatggacaatgacagcagtaaaccattatatattttgtcaactgaaaccagtaactgatggttatagtgattttcagccagcctttttcttcattttctccaactgacttctctgaagttattggtgaggaacactgccttgggcttcctgtcacagttcattaataaaggtaaagcactagtctaggagttagaacatgccacctcccataccacctcccattccacccattgcacccattccagggtccttctcttctttaggaatttctgtgactacaacttctgctgtagttaacagagaggccacccagcagcatccaataaagcaagttctcacaacctttggtgggtcaatgattcctttttccacccatattcacaaaatctncagcccntagcatcataaccaacttctgaaggaactttgcataaattttcttcaactattcaaagaatccttcaaacancctgccnttcnttaaccaaatggggcattgggttggaaatttttngagnggtccttttnaaanaaattnctattanccaaatttttttgaaccttcatttaacctgggaagtc

SEQ ID NO: 239 - DNA, 730 bp, Homo sapiens
  misc_feature (116)..(116): n is a, c, g, or t/u
  misc_feature (645)..(645): n is a, c, g, or t/u
  misc_feature (668)..(668): n is a, c, g, or t/u
  misc_feature (676)..(676): n is a, c, g, or t/u
  misc_feature (691)..(691): n is a, c, g, or t/u
  misc_feature (697)..(697): n is a, c, g, or t/u
aactttaaacaaatttttattacacaaaggttgtcacataattggatacttctctactttgtacacaattattctcactctccacagaaaggctgcttaacttctcatctggtggnggcaagcactaaaatcctgattttaacagaatagtagtaaaaatgcctcagtgatttaagttgaaagcagtacactggtacatggctcttgtacccagtatcaggaatgtacaaatgttttttattcaaaaatacaaaataaattatctgtaggcatggacaatgacagcagtaaaccattatatattttgtcaactgaaaccagtaactgatggttatagtgattttcagccagcctttttcttcattttctccaactgacttctctgaagttattggtgaggaacactgccttgggcttcctgtcacagttcattaataaaggtaaagcactagtctaggagttagaacatgccacctcccataccaccttccattccacccattgcacccattccagggtccttctcttctttaggaatttctgtgactacaacttctgctgtagttaacaagagaggccccacccagcagcatccaataaaagcagttctcacaacctttggttggggcaatgattccttttttnccccctattcaccaaaaatcttnccagcccntagcatcataacccnactttntggagggaaactttgcataaattttctcaactt

SEQ ID NO: 240 - DNA, 758 bp, Homo sapiens
  misc_feature (116)..(116): n is a, c, g, or t/u
  misc_feature (516)..(516): n is a, c, g, or t/u
  misc_feature (544)..(544): n is a, c, g, or t/u
  misc_feature (594)..(594): n is a, c, g, or t/u
  misc_feature (618)..(618): n is a, c, g, or t/u
  misc_feature (626)..(626): n is a, c, g, or t/u
  misc_feature (659)..(659): n is a, c, g, or t/u
  misc_feature (678)..(678): n is a, c, g, or t/u
  misc_feature (683)..(683): n is a, c, g, or t/u
  misc_feature (704)..(704): n is a, c, g, or t/u
  misc_feature (711)..(711): n is a, c, g, or t/u
  misc_feature (715)..(715): n is a, c, g, or t/u
aactttaaacaaatttttattacacaaaggttgtcacataattggatacttctctactttgtacacaattattctcactctccacagaaaggctgcttaacttctcatctggtggnggcaagcactaaaatcctgattttaacagaatagtagtaaaaatgcctcagtgatttaagttgaaagcagtacactggtacatggctcttgtacccagtatcaggaatgtacaaatgttttttattcaaaaatacaaaataaattatctgtaggcatggacaatgacagcagtaaaccattatatattttgtcaactgaaaccagtaactgatggttatagtgattttcagccagcctttttcttcattttctccaactgacttctctgaagttattggtgaggaacactgccttgggcttcctgtcacagttcattaataaaggtaaagcactagtctaggagttagaacatgccaccttccataccaccttccattccacccattgcacccattccanggtccttctcttctttaagaatttctgngactacaacttctgctggaggttaacaaagaggccacaccagcagcattncaataaaagccagttcttcacaanctttggtnggggtcaaaaggatttcccttttttccccccantatttcaccaaaaatcttnccaancccctttggccattcattaancccaacntttntggaagggaaacctttggccattaaaatttttcttccaacctt

SEQ ID NO: 241 - DNA, 648 bp, Homo sapiens
  misc_feature (536)..(536): n is a, c, g, or t/u
  misc_feature (617)..(617): n is a, c, g, or t/u
aactttaaacaaatttttattacacaaaggttgtcacataattggatacttctctactttgtacacaattattctcactctccacagaaaggctgcttaacttctcatctggtggtggcaagcactaaaatcctgattttaacagaatagtagtaaaaatgcctcagtgatttaagttgaaagcagtacactggtacatggctcttgtacccagtatcaggaatgtacaaatgttttttattcaaaaatacaaaataaattatctgtaggcatggacaatgacagcagtaaaccattatatattttgtcaactgaaaccagtaactgatggttatagtgattttcagccagcctttttcttcattttctccaactgacttctctgaagttattggtgaggaacactgccttgggcttcctgtcacagttcattaataaaggtaaagcactagtctaggagttagaacatgccacctcccataccacctcccattccacccattgcacccattccagggtcccttctcttcttttangaatttctggggactacaacttctgctggtagttaacagagagggcccacaccaggcagcattcccaataaagccagtttntcaccaaccctttggttggggtcaaaggatt

SEQ ID NO: 242 - DNA, 662 bp, Homo sapiens
  misc_feature (575)..(575): n is a, c, g, or t/u
  misc_feature (623)..(623): n is a, c, g, or t/u
aactttaaacaaatttttattacacaaaggttgtcacataattggatacttctctactttgtacacaattattctcactctccacagaaaggctgcttaacttctcatctggtggtggcaagcactaaaatcctgattttaacagaatagtagtaaaaatgcctcagtgatttaagttgaaagcagtacactggtacatggctcttgtacccagtatcaggaatgtacaaatgttttttattcaaaaatacaaaataaattatctgtaggcatggacaatgacagcagtaaaccattatatattttgtcaactgaaaccagtaactgatggttatagtgattttcagccagcctttttcttcattttctccaactgacttctctgaagttattggtgaggaacactgccttgggcttcctgtcacagttcattaataaaggtaaagcactagtctaggagttagaacatgccacctcccataccacctcccattccacccattgcacccattccagggtccttctcttctttaggaatttctgtgactacaacttctgctgtagttaacagagangccacacccagcagcatccaataaaagcagttctcacaacctttggtngggtcaatgattcctttttccccatattcaccaaaatct

SEQ ID NO: 243 - DNA, 1355 bp, Homo sapiens
ggatggcgatggcgtacttggcttggagactggcgcggcgttcgtgtccgagttctctgcaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagcttaaaataatgcccgtttactgagggaatttgtgggctggtttatagattttcctaaaccctttgattgcaagggggcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaac

SEQ ID NO: 244 - DNA, 797 bp, Homo sapiens
  misc_feature (518)..(518): n is a, c, g, or t/u
  misc_feature (521)..(521): n is a, c, g, or t/u
  misc_feature (525)..(525): n is a, c, g, or t/u
  misc_feature (565)..(565): n is a, c, g, or t/u
  misc_feature (615)..(615): n is a, c, g, or t/u
  misc_feature (623)..(623): n is a, c, g, or t/u
  misc_feature (630)..(630): n is a, c, g, or t/u
  misc_feature (703)..(703): n is a, c, g, or t/u
  misc_feature (714)..(714): n is a, c, g, or t/u
  misc_feature (725)..(726): n is a, c, g, or t/u
  misc_feature (729)..(729): n is a, c, g, or t/u
  misc_feature (731)..(731): n is a, c, g, or t/u
  misc_feature (738)..(738): n is a, c, g, or t/u
  misc_feature (743)..(743): n is a, c, g, or t/u
  misc_feature (745)..(745): n is a, c, g, or t/u
  misc_feature (761)..(762): n is a, c, g, or t/u
  misc_feature (779)..(779): n is a, c, g, or t/u
  misc_feature (783)..(783): n is a, c, g, or t/u
gcgtacttggcttggagactggcgcggcgttcgtgtccgaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaaagctgncancaanggatgactcaatcatcactggttttaacaaggaaatgggngactattaccagtaagtgggaatgatctgactaaacttcacttgatattncccctggngggagtnaaaggagaaaagcttaaaaataatgcccgtttttacttgagggaattttgggggctgttttattaaaattttncttaaaacctnttgattgccannggncnaatgggnccacntngggggcatttttccgnnaacccttctttgggttnttcnatgcccgggtttgc

SEQ ID NO: 245 - DNA, 812 bp, Homo sapiens
  misc_feature (575)..(575): n is a, c, g, or t/u
  misc_feature (602)..(602): n is a, c, g, or t/u
  misc_feature (666)..(666): n is a, c, g, or t/u
  misc_feature (676)..(676): n is a, c, g, or t/u
  misc_feature (689)..(689): n is a, c, g, or t/u
  misc_feature (691)..(691): n is a, c, g, or t/u
  misc_feature (720)..(720): n is a, c, g, or t/u
  misc_feature (738)..(738): n is a, c, g, or t/u
  misc_feature (759)..(759): n is a, c, g, or t/u
  misc_feature (777)..(777): n is a, c, g, or t/u
  misc_feature (802)..(802): n is a, c, g, or t/u
gttttacaaaactttttattcatcagagctgtagtgaaatatcatcattgtaattgatattctagcactacaaaaggcacaatgaagcttatttagttccagtactggaaatcagaggtaacagcacatccttccttggacatgctttactctgctgtagtggtcatcacagttttgattttctggataagaagttcaccacagcatttgtgcattcatctgatagccatcttccctgaaggacattgcattcttcagcattaacagcgtgtagtttttctctctctcttttcctgattacctcttttgaaattctcaaggcatttgggggaagctttgcaaatgccttcagcctggtccagacttctttctgaaaagtgctatcagggaaaacttcagtaacaagtccttgagcacatgcctctcccgctgttaacttctttccaaaaataagcatctctgttgccttggctgggctcattatcttcggaaaagtgtaagaggagcatccttccggactttggcctaggtgactaaatggtgtatgaaatgttgccctgtcagatgcatacacngcatcgaatagcccaaggagggtgacngagatgcccacagctggaccattgaccactgcaatcagaggcttaggaaaatctataaaacagnccacaaattncctcaataaaacngnattattttaactttcttctctctccccanggggaaaatcagggaagntagcagacattccactatggnatagtaccatttctggtnaaacagggatgaatgagtctcttgntggcgcttaa

SEQ ID NO: 246 - DNA, 744 bp, Homo sapiens
  misc_feature (627)..(627): n is a, c, g, or t/u
  misc_feature (644)..(644): n is a, c, g, or t/u
  misc_feature (676)..(676): n is a, c, g, or t/u
  misc_feature (686)..(686): n is a, c, g, or t/u
  misc_feature (706)..(706): n is a, c, g, or t/u
ggatggcgatggcgtacttggcttggagactggcgcggcgttcgtgtccgagttctctgcaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcaaggatgactcaatcatcactgttttaacaggaaatggtgactattacagtagtgggaatgatctgactaacttcactgatattncccctggtggagtagangagaaagcttaaaataatgcccgtttactganggaatttggngggctggtttatagattttnctaaaccctttgattgcaagggggcaatggtccacttg

SEQ ID NO: 247 - DNA, 890 bp, Homo sapiens
  misc_feature (529)..(529): n is a, c, g, or t/u
  misc_feature (575)..(575): n is a, c, g, or t/u
  misc_feature (577)..(577): n is a, c, g, or t/u
  misc_feature (602)..(602): n is a, c, g, or t/u
  misc_feature (633)..(633): n is a, c, g, or t/u
  misc_feature (673)..(673): n is a, c, g, or t/u
  misc_feature (675)..(675): n is a, c, g, or t/u
  misc_feature (688)..(688): n is a, c, g, or t/u
  misc_feature (690)..(690): n is a, c, g, or t/u
  misc_feature (692)..(692): n is a, c, g, or t/u
  misc_feature (719)..(719): n is a, c, g, or t/u
  misc_feature (732)..(732): n is a, c, g, or t/u
  misc_feature (749)..(749): n is a, c, g, or t/u
  misc_feature (752)..(752): n is a, c, g, or t/u
  misc_feature (777)..(777): n is a, c, g, or t/u
  misc_feature (811)..(811): n is a, c, g, or t/u
  misc_feature (816)..(816): n is a, c, g, or t/u
  misc_feature (819)..(819): n is a, c, g, or t/u
  misc_feature (848)..(848): n is a, c, g, or t/u
  misc_feature (850)..(850): n is a, c, g, or t/u
  misc_feature (857)..(857): n is a, c, g, or t/u
  misc_feature (862)..(862): n is a, c, g, or t/u
  misc_feature (879)..(879): n is a, c, g, or t/u
gttttacaaaactttttattcatcagagctgtagtgaaatatcatcattgtaattgatattctagcactacaaaaggcacaatgaagcttatttagttccagtactggaaatcagaggtaacagcacatccttccttggacatgctttactctgctgtagtggtcatcacagttttgattttctggataagaagttcaccacagcatttgtgcattcatctgatagccatcttccctgaaggacattgcattcttcagcattaacagcgtgtagtttttctctctctcttttcctgattacctcttttgaaattctcaaggcatttgggggaagctttgcaaatgccttcagcctggtccagacttctttctgaaaagtgctatcagggaaaacttcagtaacaagtccttgagcacatgcctctcccgctgttaacttctttccaaaaataagcatctctgttgccttggctgggctcattatcttcggaaaagtgtaagaggagcatccttccggactttggcctangtgactaaatggtgtatgaaatgttgccctgtcagatgcatacacngnatcgaatagcccaaggagggtgacngagatgcccacagctggaccattgccactgnaatcagaggcttaggaaaatctataaaacaagccacaaantncctcaataaaacngnantattttagctttctcctttctcaccanggggaaaatcagngaagtaggcagacattnccnctatggaaaagcaccatttctggtnaaacagggaagaatgaggcatcctgctgggcgcnttaangcnccctaattcatgaacaacttaagggtttngnatttttnttttnggccgggggaaaagacnttgggaagccc

SEQ ID NO: 248 - DNA, 876 bp, Homo sapiens
  misc_feature (681)..(681): n is a, c, g, or t/u
  misc_feature (692)..(692): n is a, c, g, or t/u
  misc_feature (694)..(694): n is a, c, g, or t/u
  misc_feature (721)..(721): n is a, c, g, or t/u
  misc_feature (727)..(727): n is a, c, g, or t/u
  misc_feature (753)..(753): n is a, c, g, or t/u
  misc_feature (755)..(755): n is a, c, g, or t/u
  misc_feature (764)..(764): n is a, c, g, or t/u
  misc_feature (775)..(775): n is a, c, g, or t/u
  misc_feature (785)..(785): n is a, c, g, or t/u
  misc_feature (790)..(790): n is a, c, g, or t/u
  misc_feature (826)..(826): n is a, c, g, or t/u
  misc_feature (843)..(843): n is a, c, g, or t/u
gttttacaaaactttttattcatcagagctgtagtgaaatatcatcattgtaattgatattctagcactacaaaaggcacaatgaagcttatttagttccagtactggaaatcagaggtaacagcacatccttccttggacatgctttactctgctgtagtggtcatcacagttttgattttctggataagaagttcaccacagcatttgtgcattcatctgatagccatcttccctgaaggacattgcattcttcagcattaacagcgtgtagtttttctctctctcttttcctgattacctcttttgaaattctcaaggcatttgggggaagctttgcaaatgccttcagcctggtccagacttctttctgaaaagtgctatcagggaaaacttcagtaacaagtccttgagcacatgcctctcccgctgttaacttctttccaaaaataagcatctctgttgccttggctgggctcattatcttcggaaaagtgtaagaggagcatccttccggactttggcctaggtgactaaatggtgtatgaaatgttgccctgtcagatgcatacacggcatcgaataagcccaaggagggtgacggagatgcccacagctggaccattgaccactgcaatcagaggcttaggaaaatctataaaacagcccacaaattccctnaagtaaaaacngnattatttttagctttcttcctctcctncaccanggggggaatattaagggaaagttagncnagatcattnccactactggnaaaagcaccnatttnctggttaaaaccagggatgaatggagtcatccttgnttggcagctttaaggcncccataaattcatgaaaccatctcaggggttat

SEQ ID NO: 249 - DNA, 611 bp, Homo sapiens
  misc_feature (269)..(269): n is a, c, g, or t/u
  misc_feature (415)..(415): n is a, c, g, or t/u
cattttataatgcgctttatttgattaaagaatttgccttctttgtatacactggaatgttatattccctatgtattttacagggttacaaaatgtctctcattttaaatattaccccaaaagtaatctcagaaaaaaaaggttttttgaaattaaacttgacttttaaaaaatcatacggacaaacaactttcaaacaaaactggattagtaggatttcttgcctgcttaactaacatgacagacttcttgtcccaggcccttctcanaaaaacctcatgtggaaaccaagctagagataagaattcttccctgatgcagttaggggaaagggaaaggctagaaacttctttggcaagcaattccacacacagccatttatgtgtgagtgctctgcttcaagcacagtacgctntttgcagggacggccagatgttcagagtgggaagtggtacttttcaaccagctaaaagtgcagaagtcatctagtcgtctgcctcttccccactgccagtgcctgcagccttgcagcaacttttaacccccccctatggactggaatattggagttaaaaagcccaaggctgaactggcttgaccctggtaaatct

SEQ ID NO: 250 - DNA, 766 bp, Homo sapiens
  misc_feature (598)..(598): n is a, c, g, or t/u
  misc_feature (636)..(636): n is a, c, g, or t/u
  misc_feature (657)..(657): n is a, c, g, or t/u
  misc_feature (674)..(674): n is a, c, g, or t/u
  misc_feature (693)..(693): n is a, c, g, or t/u
  misc_feature (696)..(696): n is a, c, g, or t/u
  misc_feature (735)..(735): n is a, c, g, or t/u
accaaaacgatgacgcagaggtgtctctcatggaggtgcgcttctacgtcccacccacccaggaggatggtgtggaccctgttgaggcctttgcccagaatgtgttgtcaaaggcggatgtaatccaggccacgggagatgccatctgcatcttccgggagctgcagtgtctgactcctcgtggtcgttatgacattcggatctaccccacctttctgcacctgcatggcaagacctttgactacaagatcccctacaccacagtactgcgtctgtttttgttaccccacaaggaccagcgccagatgttctttgtgatcagcctggatcccccaatcaagcaaggccaaactcgctaccacttcctgatcctcctcttctccaaggacgaggacatttcgttgactctgaacatgaacgaggaagaagtggagaagcgctttgagggtcggctcaccaagaacatgtcaggatccctctatgagatggtcagccgggtcatgaaagcactggtaaaccgcaagatcacagtgccaggcaacttccaagggcactcaggggcccagtgcattacctgttcctacaaggcaaagctcangactgctctacccgctggagcggggcttcatctacgtncacaagccacctgtgcacatncgcttcgatgagatctnctttgtcaactttgctcgnggnaccactactacttgttcctttgactttgaaattgaaaancaaacaggggcactcagtattaccttcagca

SEQ ID NO: 251 - DNA, 812 bp, Homo sapiens
  misc_feature (7)..(7): n is a, c, g, or t/u
  misc_feature (41)..(41): n is a, c, g, or t/u
  misc_feature (60)..(60): n is a, c, g, or t/u
  misc_feature (96)..(96): n is a, c, g, or t/u
  misc_feature (131)..(131): n is a, c, g, or t/u
  misc_feature (136)..(136): n is a, c, g, or t/u
  misc_feature (165)..(165): n is a, c, g, or t/u
  misc_feature (207)..(207): n is a, c, g, or t/u
  misc_feature (209)..(209): n is a, c, g, or t/u
  misc_feature (254)..(254): n is a, c, g, or t/u
  misc_feature (283)..(283): n is a, c, g, or t/u
  misc_feature (285)..(285): n is a, c, g, or t/u
  misc_feature (295)..(295): n is a, c, g, or t/u
  misc_feature (306)..(306): n is a, c, g, or t/u
  misc_feature (315)..(315): n is a, c, g, or t/u
  misc_feature (342)..(342): n is a, c, g, or t/u
  misc_feature (398)..(398): n is a, c, g, or t/u
  misc_feature (445)..(445): n is a, c, g, or t/u
  misc_feature (483)..(483): n is a, c, g, or t/u
  misc_feature (486)..(486): n is a, c, g, or t/u
  misc_feature (504)..(506): n is a, c, g, or t/u
  misc_feature (510)..(510): n is a, c, g, or t/u
  misc_feature (517)..(517): n is a, c, g, or t/u
  misc_feature (535)..(535): n is a, c, g, or t/u
  misc_feature (539)..(539): n is a, c, g, or t/u
  misc_feature (547)..(547): n is a, c, g, or t/u
  misc_feature (557)..(557): n is a, c, g, or t/u
  misc_feature (594)..(594): n is a, c, g, or t/u
  misc_feature (606)..(606): n is a, c, g, or t/u
  misc_feature (610)..(610): n is a, c, g, or t/u
  misc_feature (624)..(624): n is a, c, g, or t/u
  misc_feature (626)..(626): n is a, c, g, or t/u
  misc_feature (632)..(632): n is a, c, g, or t/u
  misc_feature (654)..(654): n is a, c, g, or t/u
  misc_feature (667)..(667): n is a, c, g, or t/u
  misc_feature (691)..(691): n is a, c, g, or t/u
  misc_feature (696)..(696): n is a, c, g, or t/u
  misc_feature (739)..(739): n is a, c, g, or t/u
  misc_feature (756)..(756): n is a, c, g, or t/u
  misc_feature (758)..(758): n is a, c, g, or t/u
  misc_feature (761)..(761): n is a, c, g, or t/u
  misc_feature (763)..(764): n is a, c, g, or t/u
  misc_feature (775)..(775): n is a, c, g, or t/u
ccaaagncagttccctttattaaatcattttcacagaccanaaatacaaaatgaaagtanaaataggccccaggtaggagctacaggcctggcctnacatgacccctgctccagcaacttgaacaggacangcagnagctacatccttaaggtcgggaaagtaanatgaggatttggatcctgcattgccctgcctcccaccctatntntccccaaattataaacagccatccttgggaagcagcaaagttaanacgtctccccactgccctagggacatacncnccaacagganagcatgttcanatggcacanaatccagggactgcatttcatgagganaaactggtccaaaatatgggtggggagtcggggggtgtgaaaaggcaagcgcaaanagaaccttcctccgtttctactcatcggatcctgacgctgaagcctntgagctggggggagtactggctagttcttcttcttcanagncctcgctcctcctcctcnnntttntgctctnggtctctccccgaaaagntctnatcactanacacaaactntttgctctttgaagctctcgctttaactgcccttganggacgactttgnatanatgaacccccttanangggcgngggatttctttttccatttttnaccctttaacttntctttcctcttctttggacctggnccccntcttaaaaaaaaattcgccctcggccccccctttaataattcnttttcaggggctttttntnaananncccccttcctnggcattccttaagcctttggcgaaaccccacctcccc

SEQ ID NO: 252 - DNA, 851 bp, Homo sapiens
  misc_feature (618)..(618): n is a, c, g, or t/u
  misc_feature (659)..(659): n is a, c, g, or t/u
  misc_feature (675)..(675): n is a, c, g, or t/u
  misc_feature (707)..(707): n is a, c, g, or t/u
  misc_feature (737)..(737): n is a, c, g, or t/u
  misc_feature (754)..(754): n is a, c, g, or t/u
  misc_feature (794)..(794): n is a, c, g, or t/u
  misc_feature (821)..(821): n is a, c, g, or t/u
  misc_feature (826)..(826): n is a, c, g, or t/u
  misc_feature (836)..(836): n is a, c, g, or t/u
atcaatcaacggtggcttctggcacagtggcaagagtagagccaaatattaaatggtttggaaacacacgtgtgattaagcagtcatcattacaaaaatttcaagaggaaatggatacagttatgaaggatccatacaaagttgtcatgaagcaaagcaagttaccaatgtctcttctccatgatcgaatccggcctcataacttgaaggtgcacattcttgatactgaaagttttgaaactacatttggccctaagtcacagaggaaacgaccaaacttatttgcaagtgatatgcagtctcttatcgaaaatgctgaaatgtccactgagagctatgaccagggcaaggatcgtgatttggtaactgaagacactggtgtgagaaatgaagctcaagaagagatctataaaaagggacagtccaaaagaatatggggtgagctctacaaggtgatagattcatcagatgttgtagttcaagttcttgatgctagagatccaatgggtactcgttcccctcacattgaaacttacctgaagaaggaaaaaccttggaaacacctcatttttgtacttaacaaatgtgaccttgttccaacctgggcaacaaaacggngggttgctgtcctcttccaggattatccaacacttgctttncatgcaagccttactnacccgtttggcaagggagcattcattcacttntgcggcagttttggaaagttgcccacttgncaagaaaacagatcagnggtggggtcattggcttttccaaaggttggcaaagaactnttgggataaaaacaatgggttcttaanaaagntttgcaacgnggcttcccattgagg

SEQ ID NO: 253 - DNA, 812 bp, Homo sapiens
  misc_feature (68)..(68): n is a, c, g, or t/u
  misc_feature (70)..(70): n is a, c, g, or t/u
  misc_feature (132)..(132): n is a, c, g, or t/u
  misc_feature (142)..(142): n is a, c, g, or t/u
  misc_feature (208)..(208): n is a, c, g, or t/u
  misc_feature (252)..(252): n is a, c, g, or t/u
  misc_feature (289)..(289): n is a, c, g, or t/u
  misc_feature (309)..(309): n is a, c, g, or t/u
  misc_feature (314)..(314): n is a, c, g, or t/u
  misc_feature (316)..(316): n is a, c, g, or t/u
  misc_feature (438)..(438): n is a, c, g, or t/u
  misc_feature (458)..(458): n is a, c, g, or t/u
  misc_feature (496)..(496): n is a, c, g, or t/u
  misc_feature (509)..(509): n is a, c, g, or t/u
  misc_feature (519)..(520): n is a, c, g, or t/u
  misc_feature (573)..(573): n is a, c, g, or t/u
  misc_feature (590)..(590): n is a, c, g, or t/u
  misc_feature (597)..(597): n is a, c, g, or t/u
  misc_feature (620)..(620): n is a, c, g, or t/u
  misc_feature (646)..(646): n is a, c, g, or t/u
  misc_feature (648)..(648): n is a, c, g, or t/u
  misc_feature (655)..(655): n is a, c, g, or t/u
  misc_feature (657)..(657): n is a, c, g, or t/u
  misc_feature (660)..(660): n is a, c, g, or t/u
  misc_feature (663)..(663): n is a, c, g, or t/u
  misc_feature (709)..(709): n is a, c, g, or t/u
  misc_feature (712)..(712): n is a, c, g, or t/u
  misc_feature (717)..(717): n is a, c, g, or t/u
  misc_feature (721)..(721): n is a, c, g, or t/u
  misc_feature (727)..(727): n is a, c, g, or t/u
  misc_feature (743)..(743): n is a, c, g, or t/u
  misc_feature (753)..(753): n is a, c, g, or t/u
  misc_feature (758)..(758): n is a, c, g, or t/u
  misc_feature (779)..(779): n is a, c, g, or t/u
  misc_feature (798)..(798): n is a, c, g, or t/u
  misc_feature (804)..(804): n is a, c, g, or t/u
gcctgtttttgtataatttaataaaaaccttttaaacattactgcttttgtctgaattttttgcgttngngtttctgtccctctgagtcattggtcttctttttgttcctgttcctatttttcacgttgggngtttcatagnagcgcacaccaacttttttcggccgttgctgtcgtactgctcgcctccgttcttttgatgtaagcnccctgggagctttatttgaatgttcctgttcctcttccctttgngccttccgcttctttccctttttggaaggggctctgncatctacatcttcttccagngtttntntttgttcttcaggttttgcaaatatcttttcactcagtcccttggatattctgactgctgaaaactttttggctttggctttgtctaaaaacttctgatatttggcaatcttctcatccagngctttaataacggctttggngtcgtttcccacattttcctcctcaggctccgaggaanactcttccgcatnatctctttgnngctcctgttcctcctcctcttcatcaaaaaagctctcaagctcttcctcaaanatctgacacctccacangaaccangtcatccccaaaaaactgaggcnccacgttgattttaccaaagttctgncnaactcgngnganaanctgctgcatctctggggtaagcaaacacaagggaccgggcccttcnggntcctncctnaagganggaatctggacccttnaccctgcagnttttngggactttccccccctggaangggtctgggctgggttttngggganaaacttcc

SEQ ID NO: 254 - DNA, 871 bp, Homo sapiens
  misc_feature (597)..(597): n is a, c, g, or t/u
  misc_feature (720)..(720): n is a, c, g, or t/u
  misc_feature (764)..(764): n is a, c, g, or t/u
  misc_feature (802)..(802): n is a, c, g, or t/u
  misc_feature (829)..(829): n is a, c, g, or t/u
atgctgagaaacttcggtccgttgtgatgccaatggaaaaggaaattgcagctttgaaggataaactgacagaggctgaagacaaaattaaagagctggaggcctcaaaggttaaagaactgaatcattatctggaagctgagaaatcttgtaggactgatctagagatgtatgtagctgttttgaatactcagaaatctgttctacaggaagatgctgagaaactgcggaaagaattgcatgaagtttgccatctcttggagcaagagcgacaacaacacaaccagttaaaacatacgtggcagaaggccaatgaccagtttctggaatctcagcgtttactgatgagagacatgcagcgaatggagattgtgctaacttcagaacagctccgacaagttgaagaactgaagaagaaagatcaggaggatgatgaacaacaaagactcaataagagaaaggatcacaaaaaagcagatgttgaggaagaaataaaaataccagtagtgtgtgctttaactcaagaagaatcttcagcccagttatcaaatgaagaggagcatttagacagcacccgtggctcagttcattccttanatgcaggcttgctgttgccatctggagatcctttcagtaaatcggacaatgacatgtttaaagatggactcaggagagcacagtcttccagacagctttgggaccctcgggctcattgcaatncaaagctttaggcttttaccttccaagccaaaatcttgcttggnaaccctggaccaagtcaaaatttttggacccctgggtnggaaccaaaattcaagtggtcttgganaaactttggatcctggatttccctttggggtcacctcccaaa

SEQ ID NO: 255 - DNA, 831 bp, Homo sapiens
  misc_feature (34)..(34): n is a, c, g, or t/u
  misc_feature (37)..(37): n is a, c, g, or t/u
  misc_feature (41)..(41): n is a, c, g, or t/u
  misc_feature (46)..(46): n is a, c, g, or t/u
  misc_feature (48)..(48): n is a, c, g, or t/u
  misc_feature (72)..(72): n is a, c, g, or t/u
  misc_feature (76)..(76): n is a, c, g, or t/u
  misc_feature (85)..(85): n is a, c, g, or t/u
  misc_feature (92)..(92): n is a, c, g, or t/u
  misc_feature (97)..(97): n is a, c, g, or t/u
  misc_feature (105)..(105): n is a, c, g, or t/u
  misc_feature (107)..(107): n is a, c, g, or t/u
  misc_feature (129)..(129): n is a, c, g, or t/u
  misc_feature (152)..(152): n is a, c, g, or t/u
  misc_feature (177)..(177): n is a, c, g, or t/u
  misc_feature (180)..(180): n is a, c, g, or t/u
  misc_feature (184)..(184): n is a, c, g, or t/u
  misc_feature (188)..(188): n is a, c, g, or t/u
  misc_feature (201)..(201): n is a, c, g, or t/u
  misc_feature (209)..(209): n is a, c, g, or t/u
  misc_feature (230)..(230): n is a, c, g, or t/u
  misc_feature (232)..(232): n is a, c, g, or t/u
  misc_feature (244)..(244): n is a, c, g, or t/u
  misc_feature (256)..(256): n is a, c, g, or t/u
  misc_feature (265)..(266): n is a, c, g, or t/u
  misc_feature (271)..(271): n is a, c, g, or t/u
  misc_feature (279)..(279): n is a, c, g, or t/u
  misc_feature (301)..(301): n is a, c, g, or t/u
  misc_feature (309)..(309): n is a, c, g, or t/u
  misc_feature (320)..(320): n is a, c, g, or t/u
  misc_feature (341)..(341): n is a, c, g, or t/u
  misc_feature (345)..(345): n is a, c, g, or t/u
  misc_feature (359)..(359): n is a, c, g, or t/u
  misc_feature (363)..(363): n is a, c, g, or t/u
  misc_feature (371)..(371): n is a, c, g, or t/u
  misc_feature (401)..(401): n is a, c, g, or t/u
  misc_feature (404)..(404): n is a, c, g, or t/u
  misc_feature (409)..(409): n is a, c, g, or t/u
  misc_feature (411)..(411): n is a, c, g, or t/u
  misc_feature (416)..(416): n is a, c, g, or t/u
  misc_feature (420)..(420): n is a, c, g, or t/u
  misc_feature (423)..(423): n is a, c, g, or t/u
  misc_feature (428)..(428): n is a, c, g, or t/u
  misc_feature (430)..(430): n is a, c, g, or t/u
  misc_feature (438)..(438): n is a, c, g, or t/u
  misc_feature (440)..(440): n is a, c, g, or t/u
  misc_feature (448)..(448): n is a, c, g, or t/u
  misc_feature (454)..(454): n is a, c, g, or t/u
  misc_feature (457)..(457): n is a, c, g, or t/u
  misc_feature (459)..(459): n is a, c, g, or t/u
  misc_feature (471)..(471): n is a, c, g, or t/u
  misc_feature (474)..(474): n is a, c, g, or t/u
  misc_feature (518)..(518): n is a, c, g, or t/u
  misc_feature (526)..(526): n is a, c, g, or t/u
  misc_feature (536)..(536): n is a, c, g, or t/u
  misc_feature (595)..(595): n is a, c, g, or t/u
  misc_feature (598)..(598): n is a, c, g, or t/u
  misc_feature (624)..(624): n is a, c, g, or t/u
  misc_feature (626)..(626): n is a, c, g, or t/u
  misc_feature (639)..(639): n is a, c, g, or t/u
  misc_feature (647)..(647): n is a, c, g, or t/u
  misc_feature (650)..(650): n is a, c, g, or t/u
  misc_feature (660)..(660): n is a, c, g, or t/u
  misc_feature (683)..(683): n is a, c, g, or t/u
  misc_feature (688)..(688): n is a, c, g, or t/u
  misc_feature (704)..(704): n is a, c, g, or t/u
  misc_feature (716)..(716): n is a, c, g, or t/u
  misc_feature (731)..(731): n is a, c, g, or t/u
  misc_feature (737)..(737): n is a, c, g, or t/u
  misc_feature (749)..(749): n is a, c, g, or t/u
  misc_feature (753)..(753): n is a, c, g, or t/u
  misc_feature (767)..(767): n is a, c, g, or t/u
  misc_feature (771)..(771): n is a, c, g, or t/u
  misc_feature (800)..(801): n is a, c, g, or t/u
  misc_feature (806)..(806): n is a, c, g, or t/u
acttggcagcagcttttttaatttgaacactttnttnttgnggacncnccttcagtacagttaacaaatggntacncctgaaatntgctganagcanagcttaananccacaattgcaaaggccactgntggctcacttcctcacaggctgnattacctttcaaagctgagtgaggntgngctntacntcccaatacttgntactgagnggacatgaggggcaagtttancnccttaaaggganaaaaaaataggntagtatgcnnaatgngattttgncctcacttcaccttaagtcatntttttacncttgccaatgngagttctgaaagggagtactntatntgcttaaaaatggngagngactgccnattaaaagccacatgataagggaggttacnggnaaaangnaaatnaggntanacatncntgaaaacntntaggcccngactgnatntnagcccaggaacnctngtgaaacccaactgagcttttcttttgcctaaaagggctaaatnctgccttntacatcaagntcccatttatgctgaaaacccaattgaaagaattggtttctacctggacagggacacantantttgtttatacccaaaacacattggntnaacaaaacttaanaagctcanttngggttttttntaccaaaaaaggaaattcccacncggtngggattttgccccagntgaaacccctanccctttccctaaatnggggangaatttttttancccncccccttttttttngganaaaaaaaattttttggaagggggcccaannttaanaaaaaaaacttttatttgggaaggc

SEQ ID NO: 256 - DNA, 722 bp, Homo sapiens
  misc_feature (581)..(581): n is a, c, g, or t/u
  misc_feature (709)..(709): n is a, c, g, or t/u
aagatggctgcgcccgagaagatgacgtttcccgagaaaccaagccacaaaaagtacagggccgccctgaagaaggagaaacgaaagaaacgtcggcaggaacttgctcgactgagagactcaggactctcacagaaggaggaagaggaggacacttttattgaagaacaacaactagaagaagagaagctattggaaagagagaggcaaagattacatgaggagtggttgctaagagagcagaaggcacaagaagaattcagaataaagaaggaaaaggaagaggcggctaaaaaacggcaagaagaacaagagagaaagttaaaggaacaatgggaagaacagcagaggaaagagagagaagaggaggagcagaaacgacaggagaagaaagaaaaagaggaagctttgcagaagatgctggatcaggctgaaaatgagttggaaaatggtaccacatggcaaaacccagaacccccgtggatttcagagtaatggagaaggatcgagctaattgtcccttctacagtaaaacaggagcttgcagatttggagatagatgttcacgtaaacataatttnccaacatccagtcctacccttcttattaagaacatgtttaacgacgtttggaattggagcagtgcaaggagggatgactatgacccttgacccaagccctggagttccagccgagggaagaaaccttnccacagtttccta

SEQ ID NO: 257 - DNA, 606 bp, Homo sapiens
  misc_feature (7)..(7): n is a, c, g, or t/u
  misc_feature (19)..(19): n is a, c, g, or t/u
  misc_feature (28)..(28): n is a, c, g, or t/u
  misc_feature (35)..(35): n is a, c, g, or t/u
  misc_feature (37)..(37): n is a, c, g, or t/u
  misc_feature (40)..(40): n is a, c, g, or t/u
  misc_feature (45)..(45): n is a, c, g, or t/u
  misc_feature (47)..(47): n is a, c, g, or t/u
  misc_feature (49)..(49): n is a, c, g, or t/u
  misc_feature (53)..(53): n is a, c, g, or t/u
  misc_feature (60)..(60): n is a, c, g, or t/u
  misc_feature (68)..(68): n is a, c, g, or t/u
  misc_feature (74)..(74): n is a, c, g, or t/u
  misc_feature (76)..(76): n is a, c, g, or t/u
  misc_feature (78)..(78): n is a, c, g, or t/u
  misc_feature (81)..(81): n is a, c, g, or t/u
  misc_feature (88)..(88): n is a, c, g, or t/u
  misc_feature (108)..(108): n is a, c, g, or t/u
  misc_feature (117)..(117): n is a, c, g, or t/u
  misc_feature (126)..(126): n is a, c, g, or t/u
  misc_feature (132)..(132): n is a, c, g, or t/u
  misc_feature (138)..(138): n is a, c, g, or t/u
  misc_feature (144)..(144): n is a, c, g, or t/u
  misc_feature (177)..(177): n is a, c, g, or t/u
  misc_feature (207)..(207): n is a, c, g, or t/u
  misc_feature (217)..(218): n is a, c, g, or t/u
  misc_feature (223)..(223): n is a, c, g, or t/u
  misc_feature (233)..(233): n is a, c, g, or t/u
  misc_feature (241)..(241): n is a, c, g, or t/u
  misc_feature (248)..(248): n is a, c, g, or t/u
  misc_feature (251)..(251): n is a, c, g, or t/u
  misc_feature (265)..(265): n is a, c, g, or t/u
  misc_feature (267)..(268): n is a, c, g, or t/u
  misc_feature (299)..(300): n is a, c, g, or t/u
  misc_feature (305)..(305): n is a, c, g, or t/u
  misc_feature (309)..(309): n is a, c, g, or t/u
  misc_feature (321)..(321): n is a, c, g, or t/u
  misc_feature (326)..(326): n is a, c, g, or t/u
  misc_feature (334)..(334): n is a, c, g, or t/u
  misc_feature (342)..(342): n is a, c, g, or t/u
  misc_feature (344)..(344): n is a, c, g, or t/u
  misc_feature (353)..(354): n is a, c, g, or t/u
  misc_feature (377)..(378): n is a, c, g, or t/u
  misc_feature (389)..(389): n is a, c, g, or t/u
  misc_feature (400)..(400): n is a, c, g, or t/u
  misc_feature (403)..(403): n is a, c, g, or t/u
  misc_feature (415)..(415): n is a, c, g, or t/u
  misc_feature (425)..(426): n is a, c, g, or t/u
  misc_feature (433)..(433): n is a, c, g, or t/u
  misc_feature (435)..(435): n is a, c, g, or t/u
  misc_feature (443)..(443): n is a, c, g, or t/u
  misc_feature (459)..(460): n is a, c, g, or t/u
  misc_feature (486)..(486): n is a, c, g, or t/u
  misc_feature (495)..(495): n is a, c, g, or t/u
  misc_feature (501)..(501): n is a, c, g, or t/u
  misc_feature (521)..(521): n is a, c, g, or t/u
  misc_feature (557)..(557): n is a, c, g, or t/u
  misc_feature (579)..(579): n is a, c, g, or t/u
  misc_feature (602)..(603): n is a, c, g, or t/u
aaaaaanaaaactagtttntttggattngggactntnaanagttntntntttnttacccnacctcctnctgccncnanttngggaccnaaaggaactttggctccggntgggggggntcctggggntccggntccggntccggntccgggtgccccggccccgggtgggggccctgntgggggccctattttttcctttgcttcggnaattgggccnntcccnactttttgangggcgttngggaaanttnttccccctgggacnannacttttcctttgggattccccattttttttnnaggangggnctggactagggnttttncttccccncaacctgntntaaaaatcnncgggggggcccatcctttccctnntttgggagttnttcccaaaggnggngccagtccgatntggaaacaannaaatgtntntattaccntcccaaaaataattgnngggatttctgaacccatgaaaaaagntgcagggcnttcctnttggacattggggggttttnaaaaaaacccaaatcgccatttttcaccgggtcacngggcaaaattaaaacttggagntgtgggcctgcataacaatgggnncgg

SEQ ID NO: 258 - DNA, 779 bp, Homo sapiens
  misc_feature (595)..(595): n is a, c, g, or t/u
  misc_feature (635)..(635): n is a, c, g, or t/u
  misc_feature (660)..(660): n is a, c, g, or t/u
  misc_feature (710)..(710): n is a, c, g, or t/u
  misc_feature (715)..(715): n is a, c, g, or t/u
  misc_feature (741)..(741): n is a, c, g, or t/u
gtactttgaggagttcctactcttctttctttcttattaaggtcttgttgctgggttccatgttgcaacttagataagaaaagattcttgtgagacctcaataaggatactgtaccctctgaggattcagttaccgcagactgtttgtcactaacactttttcttgtatccaaattagcttcagtttccatttcaacatcattaccactaggtttatcttgagaagttattgttcttgtccttttgctttctactacttttgccgctgccttcattagaaaggttgatgatttttcacttagcacataattcacataactcttaattttctccatcatgtggttgtagctgaagtgttgaaaaaaggaatgaaatgtatctttctgagagattatcataagcaatttgcttttgaaaggcatatgagaatttggatcaccaaatattctttcaaagacttcttctgcttctttaaagttgccattttccatacaaacagctatagcctgaattttaattaaattctgtatttcttcatgaagtttgtcatgttccttttcaattgaaccccaaatcatcagggctgattcccaanggtgtaaattcggtcatcattttcaaactggggcatcaangggtttttcctgctgcatttcttgncaaaaaactgacatatgtatatcggttctcaacctggcaaagctggttanaactnggatagtccatgaaaaaataaccctnttggcgcttgttgcgggtccctggcggaagttcctcgg

SEQ ID NO: 259 - DNA, 705 bp, Homo sapiens
  misc_feature (667)..(667): n is a, c, g, or t/u
gttgaggaaggagctggagaggcaggcggagcgacttgaaaaagaacttgcatctcagcaagagaaaagggccattgagaaagacatgatgaaaaaggaaataacgaaagaaagggagtacatgggatcaaagatgttgatcttgtctcagaatattgcccaactggaggcccaggtggaaaaggttacaaaggaaaagatttcagctattaatcaactggaggaaattcaaagccagctggcttctcgggaaatggatgtcacaaaggtgtgtggagaaatgcgctatcagctgaataaaaccaacatggagaaggatgaggcagaaaaggagcacagagagttcagagcaaaaactaacagggatcttgaaattaaagatcaggaaatagagaaattgagaatagaactggatgaaagcaaacaacacttggaacaggagcagcagaaggcagccctggccagagaggagtgcctgagactaacagaactgctgggcgaatctgagcaccaactgcacctcaccagacaggaaaaagatagcattcagcagagctttagcaaggaagcaaaggcccaagcccttcagcccagcaaagaaagcaggagcttgccacagaagatcagcaaatggaacccaccatgcaaaacttgaaaatgaacagtntttgttgcttgcctccaaaaacattttttgccaaagtt

SEQ ID NO: 260 - DNA, 755 bp, Homo sapiens
  misc_feature (316)..(316): n is a, c, g, or t/u
  misc_feature (476)..(476): n is a, c, g, or t/u
  misc_feature (534)..(534): n is a, c, g, or t/u
  misc_feature (609)..(609): n is a, c, g, or t/u
  misc_feature (636)..(636): n is a, c, g, or t/u
  misc_feature (681)..(681): n is a, c, g, or t/u
  misc_feature (683)..(683): n is a, c, g, or t/u
  misc_feature (711)..(711): n is a, c, g, or t/u
  misc_feature (752)..(752): n is a, c, g, or t/u
ctttaaaaagttcatttattgaaaatcatatgtataacctagcatacgaatgagcagatttaaacacataacttcaagccatttctgaaaacatacaccaggagctctgctcagctagagtcagactccagctccagcccgactgcgtgcggggacagcgcccgcgttgatgaggaccagccccactgcaggctgaggcggtgtcaccctgggaaggtcgtggtgcgttgtggcatattaagtctaaaccagatgaatgtaaatatctctttgtaaatcatttatttcactctgttccatccaggtcagcaatcanattgtggcatgctgggtaactgggtccgcagccggtccacctcttccgacaggctctgcctctccaggagaagctggttctgcttgctgaggagctgcaccagctgctgggctgtggcctggctgtgcttatccagctgccttagcctttgcttcatcgnctcatgtactctcccatgctggacacactgttcctccaattcttcatttcttctctgnaactttcccaatttatcatatgtataccttttttcttgactgagttgagctatttcagatctgggtttttgaganatttggtccagtttcttgggctaatgnacaacattcttcctttaacttttgtcaaaaatgtattcttgggangncaacaacaaaatactggtcattttcagntttggcatgctgggctttcatttgctggaatcttttggggnact

SEQ ID NO: 261 - DNA, 887 bp, Homo sapiens
  misc_feature (655)..(655): n is a, c, g, or t/u
  misc_feature (675)..(675): n is a, c, g, or t/u
  misc_feature (694)..(694): n is a, c, g, or t/u
  misc_feature (728)..(728): n is a, c, g, or t/u
  misc_feature (766)..(766): n is a, c, g, or t/u
  misc_feature (785)..(785): n is a, c, g, or t/u
  misc_feature (791)..(791): n is a, c, g, or t/u
  misc_feature (802)..(802): n is a, c, g, or t/u
  misc_feature (806)..(806): n is a, c, g, or t/u
  misc_feature (815)..(815): n is a, c, g, or t/u
  misc_feature (817)..(817): n is a, c, g, or t/u
  misc_feature (822)..(822): n is a, c, g, or t/u
  misc_feature (829)..(829): n is a, c, g, or t/u
  misc_feature (865)..(865): n is a, c, g, or t/u
  misc_feature (879)..(879): n is a, c, g, or t/u
cccaaacccatactaatgttcatatgcagaccatcgaaagactggttaaagaaagagatgacttgatgtctgcactagtttccgtaaggagcagcttggcagatacgcagcaaagagaagcaagtgcttatgaacaggtgaaacaagttttgcaaatatctgaggaagccaattttgaaaaaaccaaggctttaatccagtgtgaccagttgaggaaggagctggagaggcaggcggagcgacttgaaaaagaacttgcatctcagcaagagaaaagggccattgagaaagacatgatgaaaaaggaaataacgaaagaaagggagtacatgggatcaaagatgttgatcttgtctcagaatattgcccaactggaggcccaggtggaaaaggttacaaaggaaaagatttcagctattaatcaactggaggaaattcaaagccagctggcttctcgggaaatggatgtcacaaaggtgtgtggagaaatgcgctatcagctgaataaaaccaacatggagaaggatgaggcagaaaaggagcacagagagttcagagcaaaaactaacagggatcttgaaattaaagatcaggaaatagagaaattgagaatagaactggatgaaagcaaacacacttggaacaggagcagcanaaggcaccctggccaaaaangagtgcctgagactaacanaactgctgggcgaatctgaccccactgcccttanccagacaggaaaaagatacatttagcagactttacaanggaagcaaaggccaagccnttaggnccaccaaaganagcnggggcttgncncaaanatccacnaatggaagccccccttgacaaacttgaaatgacagntttgtggtgacctnccaaatcc

SEQ ID NO: 262 - DNA, 866 bp, Homo sapiens
  misc_feature (534)..(534): n is a, c, g, or t/u
  misc_feature (609)..(609): n is a, c, g, or t/u
  misc_feature (676)..(676): n is a, c, g, or t/u
  misc_feature (686)..(686): n is a, c, g, or t/u
  misc_feature (703)..(703): n is a, c, g, or t/u
  misc_feature (734)..(734): n is a, c, g, or t/u
  misc_feature (742)..(742): n is a, c, g, or t/u
  misc_feature (756)..(756): n is a, c, g, or t/u
  misc_feature (758)..(758): n is a, c, g, or t/u
  misc_feature (772)..(772): n is a, c, g, or t/u
  misc_feature (796)..(796): n is a, c, g, or t/u
  misc_feature (801)..(801): n is a, c, g, or t/u
  misc_feature (807)..(807): n is a, c, g, or t/u
  misc_feature (835)..(835): n is a, c, g, or t/u
  misc_feature (837)..(837): n is a, c, g, or t/u
  misc_feature (842)..(842): n is a, c, g, or t/u
  misc_feature (847)..(847): n is a, c, g, or t/u
  misc_feature (862)..(862): n is a, c, g, or t/u
ctttaaaaagttcatttattgaaaatcatatgtataacctagcatacgaatgagcagatttaaacacataacttcaagccatttctgaaaacatacaccaggagctctgctcagctagagtcagactccagctccagcccgactgcgtgcggggacagcgcccgcgttgatgaggaccagccccactgcaggctgaggcggtgtcaccctgggaaggtcgtggtgcgttgtggcatattaagtctaaaccagatgaatgtaaatatctctttgtaaatcatttatttcactctgttccatccaggtcagcaatcagattgtggcatgctgggtaactgggtccgcagccggtccacctcttccgacaggctctgcctctccaggagaagctggttctgcttgctgaggagctgcaccagctgctgggctgtggcctggctgtgcttatccagctgccttagcctttgcttcatcgtctcatgtactctcccatgctggacacactgttcctccaattcttcatttcttctctgnaactttcccaatttatcatatgtataccttttttcttgactgagttgagctatttcaaatctggttttttgaganattggtccagtttcttggctaatgtacaacattctttctttaactttgcaaaaatgtattctggganggcaacaacnaaaactggtcatttttnagttttggcatgctgggcttccatttgctgnatttctgnggcaactcctgctntnttttcttggccttnaaggcttgggcctttcttccttgntaaanctctgntgaaagctaactttttcctgctggggangngcaanttggngctcaaaatcccccnacaa

SEQ ID NO: 263 - DNA, 798 bp, Homo sapiens
  misc_feature (93)..(93): n is a, c, g, or t/u
  misc_feature (525)..(525): n is a, c, g, or t/u
  misc_feature (544)..(544): n is a, c, g, or t/u
  misc_feature (565)..(565): n is a, c, g, or t/u
  misc_feature (568)..(568): n is a, c, g, or t/u
  misc_feature (571)..(571): n is a, c, g, or t/u
  misc_feature (575)..(575): n is a, c, g, or t/u
  misc_feature (589)..(589): n is a, c, g, or t/u
  misc_feature (595)..(595): n is a, c, g, or t/u
  misc_feature (611)..(611): n is a, c, g, or t/u
  misc_feature (616)..(616): n is a, c, g, or t/u
  misc_feature (620)..(620): n is a, c, g, or t/u
  misc_feature (625)..(625): n is a, c, g, or t/u
  misc_feature (631)..(631): n is a, c, g, or t/u
  misc_feature (635)..(636): n is a, c, g, or t/u
  misc_feature (638)..(638): n is a, c, g, or t/u
  misc_feature (646)..(646): n is a, c, g, or t/u
  misc_feature (667)..(667): n is a, c, g, or t/u
  misc_feature (686)..(686): n is a, c, g, or t/u
  misc_feature (696)..(696): n is a, c, g, or t/u
  misc_feature (702)..(703): n is a, c, g, or t/u
  misc_feature (708)..(708): n is a, c, g, or t/u
  misc_feature (711)..(712): n is a, c, g, or t/u
  misc_feature (718)..(718): n is a, c, g, or t/u
  misc_feature (732)..(732): n is a, c, g, or t/u
  misc_feature (735)..(735): n is a, c, g, or t/u
  misc_feature (739)..(739): n is a, c, g, or t/u
  misc_feature (747)..(747): n is a, c, g, or t/u
  misc_feature (763)..(763): n is a, c, g, or t/u
  misc_feature (769)..(769): n is a, c, g, or t/u
  misc_feature (791)..(791): n is a, c, g, or t/u
gccgaccgggaaggcggctgcgctgctgggcgggggcgggagctggagccggagctggagccggggccggggcccgggtcagcgcttgagccnggagaagagtttgagatcgtggaccgaagccagctgcccggcccaggcgacctgcggagcgcaacgaggccgcgggcggccgagggctggtcggcgcccatcctgaccctggcacgcagggccaccgggaacctgtcggcgagctgcgggagcgcgctgcgcgcggccgcggggctgggcggcggggacagcggggacggcacggcgcgcgcagcttctaagtgccagatgatggaggagcgtgccaacctgatgcacatgatgaaactcagcatcaaggtgttgctccagtcggctctgagcctgggccgcagcctggatgcggaccatgcccccttgcaacaattcttttgtagtgatggagcactgcctcaaacatgggcttgaaagttaagaaaagttttattggccaaaaataaatcattttttggncctttggaacctggggganaaactttttccaaaaagcttnaanatntagnggaattagtttcanaaaatnttccaaaattaaaaanacacncttntgggnaaaagncccnnanccgggggnttttattttttgcccctaatncaaaaaaaaaaacttggcnattttttttnaaaagnngtttnttnnaaaaanaaaaaatttttttnaancggngttttttntaacccttggggtttntaattnattggaaagaaaaaaagggatnggtaatt

SEQ ID NO: 264 - DNA, 2284 bp, Homo sapiens
  misc_feature (1735)..(1735): n is a, c, g, or t/u
  misc_feature (1782)..(1782): n is a, c, g, or t/u
gcccgcgctccgctgctgttgctccattcggcgcttttctggcggctggctcctctccgctgccggctgctcctcgaccaggcctccttctcaacctcagcccgcggcgccgacccttccggcaccctcccgccccgtctcgtactgtcgccgtcaccgccgcggctccggccctggccccgatggctctgtgcaacggagactccaagctggagaatgctggaggagaccttaaggatggccaccaccactatgaaggagctgttgtcattctggatgctggtgctcagtacgggaaagtcatagaccgaagagtgagggaactgttcgtgcagtctgaaattttccccttggaaacaccagcatttgctataaaggaacaaggattccgtgctattatcatctctggaggacctaattctgtgtatgctgaagatgctccctggtttgatccaacaatattcactattggcaagcctgttcttggaatttgctatggtatgcagatgatgaataaggtatttggaggtactgtgcacaaaaaaagtgtcagaaaagatggagtttttcaacattagtgtggataatacatgttcattattcaggggccttcagaaggaagaagttgttttgcttacacatggagatagtgtagacaaagtagctgatggattcaaggttgtggcacgttctggaaacatagtagcaggcatagcaaatgaatctaaaaagttatatggagcacagttccaccctgaagttggccttacagaaaatggaaaagtaatactgaagaatttcctttatgatataactggatgcagtggaaccttcaccgtgcagaacagagaacttgagtgtattcgagagatcaaagagagagtaggcacgtcaaaagttttggttttactcagtggtggagtagactcaacagtttgtacagctttgctaaatcgtgctttgaaccaagaacaagtcattgctgtgcacattgataatggctttatgagaaaacgagaaagccagtctgttgaagaggccctcaaaaagcttggaattcaggtcaaagtgataaatgctgctcattctttctacaatggaacaacaaccctaccaatatcagatgaagatagaaccccacggaaaagaattagcaaaacgttaaatatgaccacaagtcctgaagagaaaagaaaaatcattggggatacttttgttaagattgccaatgaagtaattggagaaatgaacttgaaaccagaggaggttttccttgcccaaggtactttacggcctgatctaattgaaagtgcatcccttgttgcaagtggcaaagctgaactcatcaaaacccatcacaatgacacagagctcatcaaaaagttgagagaggagggaaaagtaatagaacctctgaaagattttcataaagatgaagtgagaattttgggcagagaacttggacttccagaagagttagtttccaggcatccatttccaggtcctggcctggcaatcagagtaatatgtgctgaagaaccttatatttgtaaggactttcctgaaaccaacaatattttgaaaatagtagctgatttttctgcaagtgttaaaaagccacataccctattacagagagtcaaagcctgcacaacagaagaggatcaggagaagctgatgcaaattaccagtctgcattcactgaatgccttcttgctgccaattaaaactgtangtgtgcagggtgactgtcgttcctacagttaccgtgtgtggaatctncagtaaagatgaacctgactgggaatcacttatttttctggctaggcttatacctcgcatgtgtcacaacgttaacagagttgtttatatatttggcccaccagttaaagaacctcctacagatgttcctcccactttcttgacaacaggggtgctcagtactttacgccaagctgattttgaggcccataacattctcagggagtctgggtatgctgggaaaatcagccagatgccggtgattttgacaccattacattttgatcgggacccacttcaaaagcagccttcatgccagagatctgtggttattcgaacctttattactagtgacttcatgactggtatacctgcaacacctggcaatgagatccctgtagaggtggtattaaagatggtcactgagattaagaagattcctggtatttctcgaattatgtatgacttaacatcaaagcccccaggaactactgagtgggagtaataaacttcttgttctatt

SEQ ID NO: 265 - DNA, 788 bp, Homo sapiens
  misc_feature (506)..(506): n is a, c, g, or t/u
  misc_feature (518)..(518): n is a, c, g, or t/u
  misc_feature (582)..(582): n is a, c, g, or t/u
  misc_feature (606)..(606): n is a, c, g, or t/u
  misc_feature (616)..(616): n is a, c, g, or t/u
  misc_feature (683)..(683): n is a, c, g, or t/u
  misc_feature (705)..(705): n is a, c, g, or t/u
  misc_feature (716)..(716): n is a, c, g, or t/u
  misc_feature (719)..(719): n is a, c, g, or t/u
  misc_feature (723)..(723): n is a, c, g, or t/u
  misc_feature (748)..(748): n is a, c, g, or t/u
  misc_feature (765)..(765): n is a, c, g, or t/u
  misc_feature (781)..(781): n is a, c, g, or t/u
gcccgcgctccgctgctgttgctccattcggcgcttttctggcggctggctcctctccgctgccggctgctcctcgaccaggcctccttctcaacctcagcccgcggcgccgacccttccggcaccctcccgccccgtctcgtactgtcgccgtcaccgccgcggctccggccctggccccgatggctctgtgcaacggagactccaagctggagaatgctggaggagaccttaaggatggccaccaccactatgaaggagctgttgtcattctggatgctggtgctcagtacgggaaagtcatagaccgaagagtgagggaactgttcgtgcagtctgaaattttccccttggaaacaccagcatttgctataaaggaacaaggattccgtgctattatcatctctggaggacctaattctgtgtatgctgaagatgctccctggtttgatccaacaatattcactattggcaagcctgttcttggaatttgctatggtatgcanatgatgaataangtatttggaggtactgtgcacaaaaaaaagtgtcagaaaagatggagtttttcaacattagtgnggataatacatgttcattattcangggcctttanaaaggaaaaattggttttggcttacacatgggagaatagtgtaaaacaaagtaacttgatggaatcnaaggttggggcaccgttctggnaaaaatagtanccnggcntttgcaaatgaattttaaaaagttnttttggagcacaagttncccccttgaagttggnctttacc

SEQ ID NO: 266 - DNA, 797 bp, Homo sapiens
  misc_feature (1)..(1): n is a, c, g, or t/u
  misc_feature (12)..(12): n is a, c, g, or t/u
  misc_feature (24)..(24): n is a, c, g, or t/u
  misc_feature (28)..(28): n is a, c, g, or t/u
  misc_feature (33)..(33): n is a, c, g, or t/u
  misc_feature (75)..(75): n is a, c, g, or t/u
  misc_feature (80)..(80): n is a, c, g, or t/u
  misc_feature (89)..(89): n is a, c, g, or t/u
  misc_feature (92)..(92): n is a, c, g, or t/u
  misc_feature (98)..(98): n is a, c, g, or t/u
  misc_feature (103)..(103): n is a, c, g, or t/u
  misc_feature (110)..(110): n is a, c, g, or t/u
  misc_feature (120)..(120): n is a, c, g, or t/u
  misc_feature (146)..(146): n is a, c, g, or t/u
  misc_feature (156)..(156): n is a, c, g, or t/u
  misc_feature (158)..(158): n is a, c, g, or t/u
  misc_feature (173)..(173): n is a, c, g, or t/u
  misc_feature (177)..(177): n is a, c, g, or t/u
  misc_feature (187)..(187): n is a, c, g, or t/u
  misc_feature (198)..(198): n is a, c, g, or t/u
  misc_feature (206)..(206): n is a, c, g, or t/u
  misc_feature (213)..(213): n is a, c, g, or t/u
  misc_feature (221)..(221): n is a, c, g, or t/u
  misc_feature (230)..(230): n is a, c, g, or t/u
  misc_feature (234)..(234): n is a, c, g, or t/u
  misc_feature (238)..(238): n is a, c, g, or t/u
  misc_feature (254)..(254): n is a, c, g, or t/u
  misc_feature (264)..(264): n is a, c, g, or t/u
  misc_feature (270)..(270): n is a, c, g, or t/u
  misc_feature (276)..(276): n is a, c, g, or t/u
  misc_feature (288)..(288): n is a, c, g, or t/u
  misc_feature (321)..(321): n is a, c, g, or t/u
  misc_feature (330)..(330): n is a, c, g, or t/u
  misc_feature (351)..(351): n is a, c, g, or t/u
  misc_feature (382)..(382): n is a, c, g, or t/u
  misc_feature (386)..(386): n is a, c, g, or t/u
  misc_feature (394)..(394): n is a, c, g, or t/u
  misc_feature (404)..(404): n is a, c, g, or t/u
  misc_feature (426)..(426): n is a, c, g, or t/u
  misc_feature (453)..(453): n is a, c, g, or t/u
  misc_feature (462)..(462): n is a, c, g, or t/u
  misc_feature (466)..(466): n is a, c, g, or t/u
  misc_feature (472)..(472): n is a, c, g, or t/u
  misc_feature (476)..(476): n is a, c, g, or t/u
  misc_feature (486)..(486): n is a, c, g, or t/u
  misc_feature (506)..(506): n is a, c, g, or t/u
  misc_feature (510)..(510): n is a, c, g, or t/u
  misc_feature (562)..(562): n is a, c, g, or t/u
  misc_feature (595)..(595): n is a, c, g, or t/u
  misc_feature (605)..(605): n is a, c, g, or t/u
  misc_feature (612)..(612): n is a, c, g, or t/u
  misc_feature (634)..(634): n is a, c, g, or t/u
  misc_feature (647)..(647): n is a, c, g, or t/u
  misc_feature (652)..(652): n is a, c, g, or t/u
  misc_feature (661)..(661): n is a, c, g, or t/u
  misc_feature (664)..(664): n is a, c, g, or t/u
  misc_feature (679)..(679): n is a, c, g, or t/u
  misc_feature (685)..(685): n is a, c, g, or t/u
  misc_feature (687)..(687): n is a, c, g, or t/u
  misc_feature (700)..(700): n is a, c, g, or t/u
  misc_feature (722)..(722): n is a, c, g, or t/u
  misc_feature (726)..(726): n is a, c, g, or t/u
  misc_feature (733)..(733): n is a, c, g, or t/u
  misc_feature (765)..(765): n is a, c, g, or t/u
  misc_feature (768)..(768): n is a, c, g, or t/u
  misc_feature (775)..(775): n is a, c, g, or t/u
  misc_feature (791)..(791): n is a, c, g, or t/u
naaaaaaacaanaagtttattacncccnctcantagttcctgggggctttgatgttaagtcatacataattcganaaatnccaggaatnttnttaatntcagngaccatntttaataccncctttacagggatctcattgccaggngttgcaggtntnccagtcatgaagtcnctantaataaaggntcgaataaccncaaatctntggcatnaaggctgnttttgaagngggncccnatcaaaatgtaatggngtcaaaatcnccggcntttggntgattttcccancatacccaaactccctgaaaatgttatgggccncaaaatcancttggcgtaaagtactgaccncccctgttgtcaaaaaagggggagtaacatntgtnggaggttntttaactggngggccaaatatataaacaactntgttaacgttgtgacacatgccaggtntaagcctanccanaaaaanaagngattcccagncagggtcatttttactgganattnccccccctaactgtgggaaccacagtcccctgcacacctacagttttaattngcccaaaaaaggctttcagtgaatgccactggnaatttgcatnaactttncccgaaccttttttgtgggcanggttttgactttntgaanaagggatgnggntttttaaccctgcanaaaaancnactcttttttttnaaaatttggtggtttaagaaancccntaaaaanataagggttttcaccaaattactttttttgcncgncccgacntgaaaaggtgcctggnaaaaac

SEQ ID NO: 267 - DNA, 929 bp, Homo sapiens
  misc_feature (571)..(571): n is a, c, g, or t/u
  misc_feature (601)..(601): n is a, c, g, or t/u
  misc_feature (624)..(624): n is a, c, g, or t/u
  misc_feature (674)..(674): n is a, c, g, or t/u
  misc_feature (700)..(700): n is a, c, g, or t/u
  misc_feature (703)..(703): n is a, c, g, or t/u
  misc_feature (724)..(724): n is a, c, g, or t/u
  misc_feature (767)..(767): n is a, c, g, or t/u
  misc_feature (769)..(769): n is a, c, g, or t/u
  misc_feature (785)..(785): n is a, c, g, or t/u
  misc_feature (789)..(789): n is a, c, g, or t/u
  misc_feature (822)..(822): n is a, c, g, or t/u
  misc_feature (840)..(840): n is a, c, g, or t/u
  misc_feature (880)..(880): n is a, c, g, or t/u
  misc_feature (885)..(885): n is a, c, g, or t/u
  misc_feature (913)..(913): n is a, c, g, or t/u
  misc_feature (922)..(922): n is a, c, g, or t/u
tggaaacatagtagcaggcatagcaaatgaatctaaaaagttatatggagcacagttccaccctgaagttggccttacagaaaatggaaaagtaatactgaagaatttcctttatgatatagctggatgcagtggaaccttcaccgtgcagaacagagaacttgagtgtattcgagagatcaaagagagagtaggcacgtcaaaagttttggttttactcagtggtggagtagactcaacagtttgtacagctttgctaaatcgtgctttgaaccaagaacaagtcattgctgtgcacattgataatggctttatgagaaaacgagaaagccagtctgttgaagaggccctcaaaaagcttggaattcaggtcaaagtgataaatgctgctcattctttctacaatggaacaacaaccctaccaatatcagatgaagatagaaccccacggaaaagaattagcaaaacgttaaatatgaccacaagtcctgaagagaaaagaaaaatcattggggatacttttgttaagattgccaatgaagtaattggagaaatgaacttgaaaccagangaggttttccttgcccaaggtctttacggnctgatctaattgaaagtgccatnccttgttgcaagtggcaaagcttgactcatcaaaacccatcacaatgacncagagctcatcaaaaagttgagagangangggaaaagtaattagaacctntggaaagatttcattaaagatgaagtgagaatttttgggccananaacttggactttccanaaanagttagttttccaggccttccattttccaggtncctgggcctgggcaattnaaaagtaatatgtgctggaaaaaacctttttttttggaangggcnttttcttgaaacccaccattttttttgnaaaataggnagctgga

SEQ ID NO: 268 - DNA, 839 bp, Homo sapiens
  misc_feature (625)..(625): n is a, c, g, or t/u
  misc_feature (642)..(642): n is a, c, g, or t/u
  misc_feature (704)..(704): n is a, c, g, or t/u
  misc_feature (707)..(707): n is a, c, g, or t/u
  misc_feature (710)..(710): n is a, c, g, or t/u
  misc_feature (755)..(755): n is a, c, g, or t/u
  misc_feature (763)..(763): n is a, c, g, or t/u
  misc_feature (771)..(771): n is a, c, g, or t/u
  misc_feature (782)..(782): n is a, c, g, or t/u
  misc_feature (786)..(786): n is a, c, g, or t/u
  misc_feature (799)..(799): n is a, c, g, or t/u
  misc_feature (816)..(817): n is a, c, g, or t/u
  misc_feature (833)..(833): n is a, c, g, or t/u
  misc_feature (836)..(836): n is a, c, g, or t/u
aatagaacaagaagtttattactcccactcagtagttcctgggggctttgatgttaagtcatacataattcgagaaataccaggaatcttcttaatctcagtgaccatctttaataccacctctacagggatctcattgccaggtgttgcaggtataccagtcatgaagtcactagtaataaaggttcgaataaccacagatctctggcatgaaggctgcttttgaagtgggtcccgatcaaaatgtaatggtgtcaaaatcaccggcatctggctgattttcccagcatacccagactccctgagaatgttatgggcctcaaaatcagcttggcgtaaagtactgagcacccctgttgtcaagaaagtgggagtaacatctgtaggaggttctttaactggtgggccaaatatataaacaactctgttaacgttgtgacacatgcgaggtataagcctagccagaaaaataaagtgattcccagtcaggttcatctttactggagattccacacacgtaactgtaggaacgacagtcaccctgcacacctacagtttttaattggcagcaagaagggcattcagtgaatgcagactggtaaatttgcatcaagcttctcctgancctcttctggtgggcangctttgactcttttggaataaggggtatggtggctttttaacaacttgccaaaaaaaatcanttnctnttttccaaaaatattggttgggttcaaggaaagtcccttccaaantataaggnttcttcanccacatttttncttntgattggccaagncccggaacctgggaaanngggtgccctgggaaanctnaac

SEQ ID NO: 269 - DNA, 845 bp, Homo sapiens
  misc_feature (605)..(605): n is a, c, g, or t/u
  misc_feature (652)..(652): n is a, c, g, or t/u
  misc_feature (727)..(727): n is a, c, g, or t/u
  misc_feature (737)..(737): n is a, c, g, or t/u
  misc_feature (742)..(742): n is a, c, g, or t/u
  misc_feature (748)..(748): n is a, c, g, or t/u
  misc_feature (754)..(754): n is a, c, g, or t/u
  misc_feature (761)..(761): n is a, c, g, or t/u
  misc_feature (772)..(772): n is a, c, g, or t/u
tagaaccccacggaaaagaattagcaaaacgttaaatatgaccacaagtcctgaagagaaaagaaaaatcattggggatacttttgttaagattgccaatgaagtaattggagaaatgaacttgaaaccagaggaggttttccttgcccaaggtactttacggcctgatctaattgaaagtgcatcccttgttgcaagtggcaaagctgaactcatcaaaacccatcacaatgacacagagctcatcagaaagttgagagaggagggaaaagtaatagaacctctgaaagattttcataaagatgaagtgagaattttgggcagagaacttggacttccagaagagttagtttccaggcatccatttccaggtcctggcctggcaatcagagtaatatgtgctgaagaaccttatatttgtaaggactttcctgaaaccaacaatattttgaaaatagtagctgatttttctgcaagtgttaaaaagccacataccctattacagagagtcaaagcctgcacaacagaagaggatcaggagaagctgatgcaaattaccagtctgcattcactgaatgccttcttgctgccaattaaaactgtangtgtgcagggtgactgtcgttcctacagttaccgtgtgtggaatctncagtaaagatgaacctgactgggaatcacttatttttttggctaggcttatccctcgcatgtgtcacaaccgttnacagagtggnttatntatttnggcccncccgttnaaagaaacctnctacagaaggttcctcccacttttttgacaccaggggggctcagtactttaccccccaacctgattttggggg

SEQ ID NO: 270 - DNA, 861 bp, Homo sapiens
  misc_feature (686)..(686): n is a, c, g, or t/u
  misc_feature (706)..(706): n is a, c, g, or t/u
  misc_feature (710)..(710): n is a, c, g, or t/u
  misc_feature (730)..(730): n is a, c, g, or t/u
  misc_feature (763)..(763): n is a, c, g, or t/u
  misc_feature (804)..(804): n is a, c, g, or t/u
  misc_feature (837)..(837): n is a, c, g, or t/u
gccgcggctccggccctggccccgatggctctgtgcaacggagactccaagctggagaatgctggaggagaccttaaggatggccaccaccactatgaaggagctgttgtcattctggatgctggtgctcagtacgggaaagtcatagaccgaagagtgagggaactgttcgtgcagtctgaaattttccccttggaaacaccagcatttgctataaaggaacaaggattccgtgctattatcatctctggaggacctaattctgtgtatgctgaagatgctccctggtttgatccagcaatattcactattggcaagcctgttcttggaatttgctatggtatgcagatgatgaataaggtatttggaggtactgtgcacaaaaaaagtgtcagagaagatggagttttcaacattagtgtggataatacatgttcattattcaggggccttcagaaggaagaagttgttttgcttacacatggagatagtgtagacaaagtagctgatggattcaaggttgtggcacgttctggaaacatagtagcaggcatagcaaatgaatctaaaaagttatatggagcacagttccaccctgaagttggccttacagaaaatggaaaagtaatactgaagaatttcctttatgatataacttggatgcagtggaaccttcaccgtgcaanaacagaaaaacttgagtgtnttcnagagatcaaaagagagagtngggcccgttaaaaagttttggtttttactcagnggggggagtagactcaacaagttttgtacaagcttttgctnaaattgggccttttgaaaccaaaaaacaaagtnattggttgggccccattggttaat

SEQ ID NO: 271 - DNA, 664 bp, Homo sapiens
  misc_feature (633)..(633): n is a, c, g, or t/u
ccactatggaggctaaggaccagaagaaacacagaaagaaaaacagtggacccaaagctgcaaagaaaaagaagcggcttctgcaggatctccagctaggagacgaagaagatgcccggaagagaaatcccaaagcttttgcagttcagtctgctgtgcggatggctcgatcctttcacaggactcaggatttgaagacaaaaaagcatcatattccagtggttgatcgaactccactagagcccccaccaatagtggtagtggtgatgggacctccaaaagttggaaagagcactttgatacaatgcctcattcggaactttacccggcagaagttgactgagatcagaggccctgtgacgattgtgtcaggtaaaaagcgcagactcaccattattgaatgtgggtgtgacattaacatgatgattgatctggctaaagtagcagatctggtactgatgcttatagatgccagctttgggtttgaaatggaaacgtttgagtttctaaacatctgtcaagtacatggctttcctaaaattatgggagttctcacccacctcgacttcttcaagcataataagccaactggaggaagacaaagaagccgattaaaacacaggttctggaccnggaagtttaccccgggtgcccaagctgttct

SEQ ID NO: 272 - DNA, 875 bp, Homo sapiens
  misc_feature (650)..(650): n is a, c, g, or t/u
  misc_feature (668)..(668): n is a, c, g, or t/u
  misc_feature (709)..(709): n is a, c, g, or t/u
  misc_feature (724)..(724): n is a, c, g, or t/u
  misc_feature (750)..(750): n is a, c, g, or t/u
  misc_feature (762)..(762): n is a, c, g, or t/u
  misc_feature (766)..(766): n is a, c, g, or t/u
  misc_feature (769)..(769): n is a, c, g, or t/u
  misc_feature (788)..(788): n is a, c, g, or t/u
  misc_feature (811)..(811): n is a, c, g, or t/u
  misc_feature (815)..(815): n is a, c, g, or t/u
  misc_feature (836)..(836): n is a, c, g, or t/u
  misc_feature (849)..(849): n is a, c, g, or t/u
gtaacaaaaaaatattttaatgatatttctgtaggacaaaataattaaactgaggcaggcagaggaaagtaagagaatccacataaccacagcttacatcactttaaatctcgacagccccaagtcatgagaatgaacccagtcccagcagcccaggcttctctgttcctcctcctgcaggcacagtttgagtagagacatctcttgagctctttcccactgacttgtcattcacaggcattcaaactgtgatgtttgaaactgtctacctccgcagatccagggacagtccctccagtccaaaggctcactgcaattggccctcagcccccttcaaactggacttctggtttcttctttccttctgcccctgaattctgaagagcttcttcctgaggtccttctgccgcttcagcttctcctcctcctccttctgcttggctctgaagtgctctttattgtgcaggtgccgctgctccttggccttcttcatcttctgactatgcaccgtactcagagcatccagcagtgcaaggatctttctttcatgaggctcgcgtatgacggccggtctccgcctgtcctttggcaccttgcctgcctttgcttgggtcttgggcttgttcttaaatggcagggccttctgcaangcttttggaatgtgcagngaattaaaatgtttcttttgcctcaggatggcttatacaanaaagtccttggtcgnctttagtctgacgccattgggcgaancctgaatttggnccgnggnccgaattcctggaccaggnggctttcttaccccctgggtttnaaanaaaaaggttactggggtatanaacccttgggatnggaaacaggataccaagtttccattg

SEQ ID NO: 273 - DNA, 813 bp, Homo sapiens
  misc_feature (30)..(30): n is a, c, g, or t/u
  misc_feature (51)..(51): n is a, c, g, or t/u
  misc_feature (73)..(73): n is a, c, g, or t/u
  misc_feature (87)..(87): n is a, c, g, or t/u
  misc_feature (129)..(129): n is a, c, g, or t/u
  misc_feature (159)..(159): n is a, c, g, or t/u
  misc_feature (161)..(161): n is a, c, g, or t/u
  misc_feature (181)..(181): n is a, c, g, or t/u
  misc_feature (193)..(193): n is a, c, g, or t/u
  misc_feature (195)..(195): n is a, c, g, or t/u
  misc_feature (200)..(200): n is a, c, g, or t/u
  misc_feature (202)..(202): n is a, c, g, or t/u
  misc_feature (248)..(248): n is a, c, g, or t/u
  misc_feature (275)..(275): n is a, c, g, or t/u
  misc_feature (312)..(312): n is a, c, g, or t/u
  misc_feature (460)..(460): n is a, c, g, or t/u
  misc_feature (466)..(466): n is a, c, g, or t/u
  misc_feature (542)..(542): n is a, c, g, or t/u
  misc_feature (566)..(566): n is a, c, g, or t/u
  misc_feature (627)..(627): n is a, c, g, or t/u
  misc_feature (636)..(636): n is a, c, g, or t/u
  misc_feature (642)..(642): n is a, c, g, or t/u
  misc_feature (650)..(650): n is a, c, g, or t/u
  misc_feature (657)..(657): n is a, c, g, or t/u
  misc_feature (671)..(671): n is a, c, g, or t/u
  misc_feature (677)..(677): n is a, c, g, or t/u
  misc_feature (690)..(690): n is a, c, g, or t/u
  misc_feature (716)..(717): n is a, c, g, or t/u
  misc_feature (728)..(728): n is a, c, g, or t/u
  misc_feature (730)..(730): n is a, c, g, or t/u
  misc_feature (750)..(750): n is a, c, g, or t/u
  misc_feature (767)..(767): n is a, c, g, or t/u
  misc_feature (781)..(781): n is a, c, g, or t/u
  misc_feature (785)..(785): n is a, c, g, or t/u
aacaaaaaaatattttaatgatatttctgnaggacaaaataattaaactgnggcaggcagaggaaagtaaganaatccacataaccncagcttacatcactttaaatctcgacagccccaagtcatganaatgaacccagtcccagcagcccaggcttntntgttcctcctcctgcaggcncagtttgagtananacatntnttgagctctttcccactgacttgtcattcacaggcattcaaactgngatgtttgaaactgtctacctccgcanatccagggacagtccctccagtccaaaggctcactgnaattggccctcagcccccttcaaactggacttctggtttcttctttccttctgcccctgaattctgaagagcttcttcctgaggtccttctgccgcttcagcttctcctcctcctccttctgcttggctctgaagggctctttattgngcaggngccgctgctccttggccttcttcatcttctgactatgcaccgtactcaaagcatccagcagtgcaagggatctttntttcatgaaggctcgcgtatgacngccgggctccgcctgtccttttggcaccttgcctgccttttggtttggggcttgggcttgnttcttaaanggggangggccttntggcaangggttttgggaaanggccanggaaattaaaaangtttctttttgccctcaaggattggnnttataccaaananggcccttgtttccccctttnatttttggacccccttngggccaacccttanattnggcccggggggccccattccttggacca

SEQ ID NO: 274 - DNA, 800 bp, Homo sapiens
  misc_feature (625)..(625): n is a, c, g, or t/u
  misc_feature (631)..(631): n is a, c, g, or t/u
  misc_feature (633)..(633): n is a, c, g, or t/u
  misc_feature (640)..(640): n is a, c, g, or t/u
  misc_feature (646)..(646): n is a, c, g, or t/u
  misc_feature (648)..(648): n is a, c, g, or t/u
  misc_feature (660)..(660): n is a, c, g, or t/u
  misc_feature (711)..(711): n is a, c, g, or t/u
  misc_feature (713)..(713): n is a, c, g, or t/u
  misc_feature (734)..(734): n is a, c, g, or t/u
  misc_feature (739)..(739): n is a, c, g, or t/u
  misc_feature (744)..(744): n is a, c, g, or t/u
  misc_feature (761)..(761): n is a, c, g, or t/u
  misc_feature (768)..(768): n is a, c, g, or t/u
  misc_feature (775)..(775): n is a, c, g, or t/u
  misc_feature (778)..(778): n is a, c, g, or t/u
aacaaaaaaatattttaatgatatttctgtaggacaaaataattaaactgaggcaggcagaggaaagtaagagaatccacataaccacagcttacatcactttaaatctcgacagccccaagtcatgagaatgaacccagtcccagcagcccaggcttctctgttcctcctcctgcaggcacagtttgagtagagacatctcttgagctctttcccactgacttgtcattcacaggcattcaaactgtgatgtttgaaactgtctacctccgcagatccagggacagtccctccagtccaaaggctcactgcaattggccctcagcccccttcaaactggacttctggtttcttctttccttctgcccctgaattctgaagagcttcttcctgaggtccttctgccgcttcagcttctcctcctcctccttctgcttggctctgaagtgctctttattgtgcaggtgccgctgctccttggccttcttcatcttctgactatgcaccgtactcagagcatccagcagtgcaaggatctttctttcatgaggctcgcgtatgacggccggtctccgcctgtctttggcaccttgcctgcctttgcttgggcttgggcttggtcttnaatggnanggccttntgcaangnttttgggaatgngcaagggaattaaaaaggtttcttttggcctaaggattggcttattcaaanangtccttggtcgccttttagtntgacnccatngggcgaaccctgaattnggcccgngggcccncanttcctggaccagggggtttttt

SEQ ID NO: 275 - DNA, 753 bp, Homo sapiens
  misc_feature (563)..(563): n is a, c, g, or t/u
  misc_feature (647)..(647): n is a, c, g, or t/u
  misc_feature (686)..(686): n is a, c, g, or t/u
  misc_feature (732)..(732): n is a, c, g, or t/u
gattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtatatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaangtgtcatttctaagattatcatcttcagcagtggtggtgaagttaaatgtgaatttgaacacaaggtcataaaagaaaaggttncttcaagacctattctgaaacagaaatgttctagcctanagaaactaagactggaagaagacaaaaaattggaagagaaaggatnccaaaaaaaagaaccaaaaag

SEQ ID NO: 276 - DNA, 673 bp, Homo sapiens
  misc_feature (350)..(350): n is a, c, g, or t/u
  misc_feature (476)..(476): n is a, c, g, or t/u
  misc_feature (619)..(620): n is a, c, g, or t/u
  misc_feature (624)..(624): n is a, c, g, or t/u
  misc_feature (657)..(657): n is a, c, g, or t/u
cttgagccgtgatgcaaccttcttcagtgcaatacagttgtcaatcacaacaaaacgagggcatcccaagagaaaaggttttaaacctcctgctttttctagtatctgtcgagtttcttctgggaaaaactcatattctgcagagaacatcttgttactcatgtccaagggaccatgttcctccaaaaactgagagaagtaatcatatagagttgaacatttttgttttgggttcatgtcccatagcttcttattgcggacaacatattcgttactgtgttggtcatagagagcttcgaattcttctacatcttgccgaagatggtcaggcactgcaaatgggcctgcanaatctgaatttcgattgctatggtcttcacttgaagtgatgatctcattatttgaagttactgaagttgttccagacccaactaacataggctttgaatcctttggcttctttttcttgcttttgnttttcaccttggttgaactaaacggtgcttcaccactatcttgtttccttaacacagtacaagcgggtgtccattatatcaaaagaattcatctaaagcactatgcaatgctggggaaccttggcttctggggtcttctagcnncccntattttaaacaaaccgggcctttccttcaaatngaagcctgggcttcca

SEQ ID NO: 277 - DNA, 661 bp, Homo sapiens
  misc_feature (617)..(617): n is a, c, g, or t/u
  misc_feature (632)..(632): n is a, c, g, or t/u
agttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaagggattttctacaagggaatatgtcttacccctgactgtgaangggtcatttctaaanattatcatcttcagcagtgggtgggtgaa

SEQ ID NO: 278 - DNA, 867 bp, Homo sapiens
  misc_feature (502)..(502): n is a, c, g, or t/u
  misc_feature (675)..(675): n is a, c, g, or t/u
  misc_feature (679)..(679): n is a, c, g, or t/u
  misc_feature (698)..(698): n is a, c, g, or t/u
  misc_feature (716)..(716): n is a, c, g, or t/u
  misc_feature (725)..(725): n is a, c, g, or t/u
  misc_feature (766)..(766): n is a, c, g, or t/u
  misc_feature (772)..(772): n is a, c, g, or t/u
  misc_feature (800)..(800): n is a, c, g, or t/u
  misc_feature (814)..(814): n is a, c, g, or t/u
  misc_feature (816)..(816): n is a, c, g, or t/u
  misc_feature (824)..(824): n is a, c, g, or t/u
  misc_feature (835)..(835): n is a, c, g, or t/u
  misc_feature (852)..(852): n is a, c, g, or t/u
  misc_feature (862)..(862): n is a, c, g, or t/u
cttgagccgtgatgcaaccttcttcagtgcaatacagttgtcaatcacaacaaaacgagggcatcccaagagaaaaggttttaaacctcctgctttttctagtatctgtcgagtttcttctgggaaaaactcatattctgcagagaacatcttgttactcatgtccaagggaccatgttcctccaaaaactgagagaagtaatcatatagagttgaacatttttgttttgggttcatgtcccatagcttcttattgcggacaacatattcgttactgtgttggtcatagagagcttcgaattcttctacatcttgccgaagatggtcaggcactgcaaatgggcctgcagaatctgaatttcgattgctatggtcttcacttgaagtgatgatctcattatttgaagttactgaagttgttccagacccaactaacataggctttgaatcctttggcttctttttcttgcttttgtttttcaccttggttgaactaaacggngcttcaccactatcttgtttccttaacacagtacagcgggtgccattatatcaaagaattcatctaaagcactatgcaatgctggggaacttggctctggggtcttctagcaccatattaaacaacggctttctttaatgatgctggctcaaaaaaaaaatcaaagtgctttncttntataaagctaagttgggancttttttttatttccaanggaaaggcntgattcttaaaatcaagccgtttaaaaaagctccttaccanaaaaanaaagttctggggcatttaaaccaagctnttaaattttgggancnggcgggtnatttgggctcncttttttaactccctcnaaaaatgccnaaaat

SEQ ID NO: 279 - DNA, 719 bp, Homo sapiens
  misc_feature (502)..(502): n is a, c, g, or t/u
  misc_feature (544)..(544): n is a, c, g, or t/u
  misc_feature (548)..(548): n is a, c, g, or t/u
  misc_feature (637)..(637): n is a, c, g, or t/u
  misc_feature (657)..(657): n is a, c, g, or t/u
  misc_feature (667)..(667): n is a, c, g, or t/u
  misc_feature (672)..(672): n is a, c, g, or t/u
  misc_feature (674)..(674): n is a, c, g, or t/u
  misc_feature (681)..(681): n is a, c, g, or t/u
  misc_feature (696)..(696): n is a, c, g, or t/u
  misc_feature (699)..(699): n is a, c, g, or t/u
  misc_feature (713)..(713): n is a, c, g, or t/u
cttgagccgtgatgcaaccttcttcagtgcaatacagttgtcaatcacaacaaaacgagggcatcccaagagaaaaggttttaaacctcctgctttttctagtatctgtcgagtttcttctgggaaaaactcatattctgcagagaacatcttgttactcatgtccaagggaccatgttcctccaaaaactgagagaagtaatcatatagagttgaacatttttgttttgggttcatgtcccatagcttcttattgcggacaacatattcgttactgtgttggtcatagagagcttcgaattcttctacatcttgccgaagatggtcaggcactgcaaatgggcctgcagaatctgaatttcgattgctatggtcttcacttgaagtgatgatctcattatttgaagttactgaagttgttccagacccaactaacataggctttgaatcctttggcttctttttcttgcttttgtttttcaccttggttgaactaaacggngcttcaccactatcttgtttccttaacacaagtacaagcggntgtncattatatcaaaagaattcatcttaaagcactatgcaatgctggggaacttggctctgggttcttctagccagccatattaaaacaacnggcttccttcaaatgatgcntggctcaaanaaaanantcaaggntgcttttccttctantanaagcctagtttggngaccct

SEQ ID NO: 280 - DNA, 764 bp, Homo sapiens
  misc_feature (750)..(750): n is a, c, g, or t/u
agaagacgaaaaacgtcgaagaaaggaagaggaggaaaggcggatgaaacttgagatggaagcaaagagaaaacaagaagaagaagagagaaagaaaagggaagatgatgaaaaacgcattcaagctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggagcttggattcctatccggtaacttctaaaaatgatggaacaagacccaaaatgacaccggaacaaatggccaaagaaatgtcagaatttttgagtagaggtcctgctgtactagccaccaaagcagctgctggtactaagaaatatgatcttagtaaatggaaatatgcagaactacgtgataccatcaatacttcttgtgatattgagctcctggcagcttgcagagaagaatttcataggagactaaaagtgtatcatgcttggaaatctaagaacaagaagagaaatctggaacagagcaacgtgctccaaagtctgttactgattatgctcagcaaaacccagcagctttaaaattccttgccaggcagcgggagattgaaatgaaaccgacaggcacgcttttttccgcattccattcattccgcccttgccgacccagttccaaagaccccttcagagtnagaaaaaaaaggct

SEQ ID NO: 281 - DNA, 893 bp, Homo sapiens
  misc_feature (26)..(26): n is a, c, g, or t/u
  misc_feature (40)..(40): n is a, c, g, or t/u
  misc_feature (48)..(48): n is a, c, g, or t/u
  misc_feature (64)..(64): n is a, c, g, or t/u
  misc_feature (67)..(67): n is a, c, g, or t/u
  misc_feature (92)..(92): n is a, c, g, or t/u
  misc_feature (98)..(98): n is a, c, g, or t/u
  misc_feature (112)..(112): n is a, c, g, or t/u
  misc_feature (122)..(122): n is a, c, g, or t/u
  misc_feature (125)..(125): n is a, c, g, or t/u
  misc_feature (127)..(127): n is a, c, g, or t/u
  misc_feature (145)..(145): n is a, c, g, or t/u
  misc_feature (148)..(148): n is a, c, g, or t/u
  misc_feature (174)..(174): n is a, c, g, or t/u
  misc_feature (192)..(192): n is a, c, g, or t/u
  misc_feature (205)..(205): n is a, c, g, or t/u
  misc_feature (209)..(209): n is a, c, g, or t/u
  misc_feature (213)..(213): n is a, c, g, or t/u
  misc_feature (244)..(244): n is a, c, g, or t/u
  misc_feature (258)..(258): n is a, c, g, or t/u
  misc_feature (264)..(264): n is a, c, g, or t/u
  misc_feature (266)..(266): n is a, c, g, or t/u
  misc_feature (275)..(275): n is a, c, g, or t/u
  misc_feature (278)..(278): n is a, c, g, or t/u
  misc_feature (302)..(302): n is a, c, g, or t/u
  misc_feature (310)..(310): n is a, c, g, or t/u
  misc_feature (315)..(315): n is a, c, g, or t/u
  misc_feature (335)..(335): n is a, c, g, or t/u
  misc_feature (344)..(344): n is a, c, g, or t/u
  misc_feature (348)..(348): n is a, c, g, or t/u
  misc_feature (357)..(357): n is a, c, g, or t/u
  misc_feature (363)..(363): n is a, c, g, or t/u
  misc_feature (367)..(367): n is a, c, g, or t/u
  misc_feature (371)..(371): n is a, c, g, or t/u
  misc_feature (374)..(374): n is a, c, g, or t/u
  misc_feature (378)..(378): n is a, c, g, or t/u
  misc_feature (389)..(389): n is a, c, g, or t/u
  misc_feature (404)..(406): n is a, c, g, or t/u
  misc_feature (410)..(410): n is a, c, g, or t/u
  misc_feature (416)..(416): n is a, c, g, or t/u
  misc_feature (436)..(436): n is a, c, g, or t/u
  misc_feature (442)..(442): n is a, c, g, or t/u
  misc_feature (462)..(462): n is a, c, g, or t/u
  misc_feature (464)..(464): n is a, c, g, or t/u
  misc_feature (478)..(478): n is a, c, g, or t/u
  misc_feature (486)..(486): n is a, c, g, or t/u
  misc_feature (512)..(512): n is a, c, g, or t/u
  misc_feature (519)..(519): n is a, c, g, or t/u
  misc_feature (528)..(528): n is a, c, g, or t/u
  misc_feature (550)..(550): n is a, c, g, or t/u
  misc_feature (566)..(566): n is a, c, g, or t/u
  misc_feature (571)..(571): n is a, c, g, or t/u
  misc_feature (574)..(574): n is a, c, g, or t/u
  misc_feature (618)..(618): n is a, c, g, or t/u
  misc_feature (625)..(625): n is a, c, g, or t/u
  misc_feature (627)..(627): n is a, c, g, or t/u
  misc_feature (631)..(631): n is a, c, g, or t/u
  misc_feature (634)..(634): n is a, c, g, or t/u
  misc_feature (655)..(655): n is a, c, g, or t/u
  misc_feature (681)..(681): n is a, c, g, or t/u
  misc_feature (685)..(685): n is a, c, g, or t/u
  misc_feature (712)..(712): n is a, c, g, or t/u
  misc_feature (744)..(744): n is a, c, g, or t/u
  misc_feature (758)..(758): n is a, c, g, or t/u
  misc_feature (763)..(763): n is a, c, g, or t/u
  misc_feature (770)..(770): n is a, c, g, or t/u
  misc_feature (772)..(772): n is a, c, g, or t/u
  misc_feature (803)..(803): n is a, c, g, or t/u
  misc_feature (819)..(819): n is a, c, g, or t/u
  misc_feature (848)..(848): n is a, c, g, or t/u
  misc_feature (854)..(855): n is a, c, g, or t/u
  misc_feature (870)..(870): n is a, c, g, or t/u
actttataattttattctaaaatacnacaaaactccttanaattatgncagcataactccttgntgnatttttggctttaaattccaaatgngaaagncataaatattaggnttaaagctgntgncntttgaatcaatactaacngcncacaaagaaaacattttaaaattatnagttatgtaaaacaagcncttactaaatacnaggntttntgaattacaaagcttatgaaacagggctacnattaccaaaacctnaaaggncnaaaaagacnctnggaatttcttaaaaagaaagatgntggaagcngaacncttactaaatcaatgaaacnacttggacnagantctgatacnaaaatnactnttgngangaanttgaaagaatntttgaattcagtccnnntaanccactntgccacctaaaacctatttncttttntaattgaaacaaaacttatntnaaaacttttaggcntttaaacnatctgaatttcctttatttttccccngaatttnaaaagaatnttctgacagcaacacacattgngcttgcaaagaaaagncaatntgngctggatactattagtaccccttatcccagaatacatcaattcntttaggntntttntanaatttttagaactttcgaagnggttttatttcaacttaagaccctgncaangggggggaaaaaaaatggattttttcnccccttttaatgggaaattttccaaaaaatgngcttggaaaaatgngcttntaaaagnanccccaaggttttttcaaaaaccaaaaaaaantaggggggccttggancaattttaaaagggggggttaagttattngggaannaaaaggtaaaacctnatggtttttatttacctcccagt

SEQ ID NO: 282 - DNA, 787 bp, Homo sapiens
  misc_feature (620)..(620): n is a, c, g, or t/u
  misc_feature (675)..(675): n is a, c, g, or t/u
  misc_feature (682)..(682): n is a, c, g, or t/u
  misc_feature (689)..(689): n is a, c, g, or t/u
  misc_feature (693)..(693): n is a, c, g, or t/u
  misc_feature (745)..(745): n is a, c, g, or t/u
  misc_feature (748)..(748): n is a, c, g, or t/u
  misc_feature (754)..(754): n is a, c, g, or t/u
ggaaagaaaaagacgtgaagaagacgaaaaacgtcgaagaaaggaagaggaggaaaggcggatgaaacttgagatggaagcaaagagaaaacaagaagaagaagagagaaagaaaagggaagatgatgaaaaacgcattcaagctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggagaggtcctgctgtactagccaccaaagcagctgctggtactaagaaatatgatcttagtaaatggaaatatgcagaactacgtgataccatcaatacttcttgtgatattgagctcctggcagcttgcagagaagaatttcataggagactaaaagtgtatcatgcttggaaatctaagaacaagaagagaaatactgaaacagagcaacgtgctccaaagtctgttactgattatgctcagcaaaacccagcagctcagattcctgccaggcagcgggagattgaaatgaacccgacagcaacgcttctttcgcatnccattcattccgccttgcccgaccagtacaaaagaccctcagagtaagaaaaaanggctggnggtatgncccntttgatggaccatgggattgcccggccaaatggaacttcattcttgacaagnccncccttnctacttttggcttggtaagggccaacattggga

SEQ ID NO: 283 - DNA, 724 bp, Homo sapiens
  misc_feature (575)..(575): n is a, c, g, or t/u
  misc_feature (616)..(616): n is a, c, g, or t/u
  misc_feature (622)..(622): n is a, c, g, or t/u
  misc_feature (628)..(628): n is a, c, g, or t/u
  misc_feature (642)..(642): n is a, c, g, or t/u
  misc_feature (652)..(652): n is a, c, g, or t/u
  misc_feature (666)..(666): n is a, c, g, or t/u
  misc_feature (675)..(675): n is a, c, g, or t/u
actttataattttattctaaaatacaacaaaactccttagaattatgtcagcataactccttgatgtatttttgtctttaaattccaaatgtgaaagtcataaatattaggcttaaagctgctgacatttgaatcaatactaacagcacacaaagaaaacattttaaaattatcagttatgtaaaacaagcacttactaaatacaaggatttctgaattacaaagcttatgaaacaggtctacaattaccaaaacctcaaaggccaaaaaagacactaggaatttcttaaaaagaaagatgttggaagcagaacacttactaaatcaatgaaacaacttggacaagattctgatacaaaaatcactattgagatgaagttgaaagaatatttgaattcagtccagttaagccactatgccacctaaaacctatttccttttctaattgaaacaaaacttatctcaaaacttttaggcatttaaacaatctgaatttcctttatttttccacagaatataaaaagaattttctgacagcaacacacattgtgctagcaaaagaaaagcaaatctgngctggatctattaagtacctcttattcccagaattccatcnaatacntttaanggctctttcttaanaattcttaanaaccttccgaaagnggttttcantttcaaacctaaagaccacttgcaaaagggggggaaaaaaaaatttgga

SEQ ID NO: 284 - DNA, 729 bp, Homo sapiens
  misc_feature (510)..(510): n is a, c, g, or t/u
  misc_feature (575)..(575): n is a, c, g, or t/u
  misc_feature (622)..(622): n is a, c, g, or t/u
  misc_feature (627)..(627): n is a, c, g, or t/u
  misc_feature (640)..(640): n is a, c, g, or t/u
  misc_feature (648)..(649): n is a, c, g, or t/u
  misc_feature (658)..(658): n is a, c, g, or t/u
  misc_feature (670)..(670): n is a, c, g, or t/u
  misc_feature (698)..(698): n is a, c, g, or t/u
  misc_feature (702)..(702): n is a, c, g, or t/u
actttataattttattctaaaatacaacaaaactccttagaattatgtcagcataactccttgatgtatttttgtctttaaattccaaatgtgaaagtcataaatattaggcttaaagctgctgacatttgaatcaatactaacagcacacaaagaaaacattttaaaattatcagttatgtaaaacaagcacttactaaatacaaggatttctgaattacaaagcttatgaaacaggtctacaattaccaaaacctcaaaggccaaaaaagacactaggaatttcttaaaaagaaagatgttggaagcagaacacttactaaatcaatgaaacaacttggacaagattctgatacaaaaatcactattgagatgaagttgaaagaatatttgaattcagtccagttaagccactatgccacctaaaacctatttccttttctaattgaaacaaaacttatctcaaaacttttaggcatttaaacaatctgaatttcctttatttttccncagaatataaaaaggaatattctgacagcaacacacattgtgctagcaaagaaaagcaaatctgngctggatactattaggtaccctcttatcccggaatacatcaaatacnttaanggctcttttctanaattctannaaccttcgnaagtggtttcanttcaaaacctaaagacccctggccaaangggngggaaaaaaaaattaggaatttttccc

SEQ ID NO: 285 - DNA, 650 bp, Homo sapiens
  misc_feature (512)..(512): n is a, c, g, or t/u
  misc_feature (542)..(542): n is a, c, g, or t/u
  misc_feature (547)..(547): n is a, c, g, or t/u
  misc_feature (576)..(576): n is a, c, g, or t/u
  misc_feature (644)..(644): n is a, c, g, or t/u
aaactggccctgtctgatggtggaatcatttcaggagtaagaacgtgaggaggatcaatttacaaaagaacatcataggatcaagtcctgttgcagatttctctgctattaaggaactagatactcttaacaatgaaatagttgacctacagagggaaaagaataatgtggaacaggaccttaaggagaaggaagatactattaaacagaggacaagtgaggttcaggatcttcaagatgaagttcaaagggagaatactaatctgcaaaaactacaggcccagaaacagcaggtacaggaactccttgatgaactggatgagcagaaagcccagctggaggagcaactcaaggaagtcagaaagaaatgtgctgaggaggcccaactgatctcttctctgaaagctgaattaactagtcaggaatcgcagatctccacttatgaagaagaattggcaaaagctagagaagaactgagccgtctacagcaagaaacacagaattggaggganagtgtaaagtcagggaaggctcagtttggnacctntttagcagcacctacaagattcacaacanggaaattagttcaatgccaatgaaacttgttggaatgaaagattttggaaaatcattatagtcagttnaattgg

SEQ ID NO: 286 - DNA, 772 bp, Homo sapiens
  misc_feature (599)..(599): n is a, c, g, or t/u
  misc_feature (659)..(659): n is a, c, g, or t/u
  misc_feature (672)..(672): n is a, c, g, or t/u
  misc_feature (709)..(709): n is a, c, g, or t/u
  misc_feature (716)..(716): n is a, c, g, or t/u
  misc_feature (736)..(736): n is a, c, g, or t/u
  misc_feature (746)..(746): n is a, c, g, or t/u
  misc_feature (755)..(755): n is a, c, g, or t/u
  misc_feature (758)..(758): n is a, c, g, or t/u
aattggatattttggaatttatttataggctaggcaataagttactcagattaacacagatcaataccaccttgacttgttgacccagagaattctaattagattttaggtgcatttttctttatcttggtatttaatacatcatctaagtcagtaaccgtgttaaacaaaattaaaatgacaagttacagcttacttcacagtctatttcaaattcagcttgtccactaggtcagttttacaggagatggtcttttaacatgaagaggtctgataatctggcaggtctcttctctcccaattaaaaaaacaagagtttttttgctagcttgacaattttataggtgaaaaacatgaagtgagtaaataaactaaaccacaaagatggacaaaaagcaatatgatataaaacacatcactttttctatttgtattcagtgaaagtttttacatttcaagtaaatgagccttcattaaaaaaaaaaaacaaatatatatgaaaaattaaagtccttccagttctagcttgctgaagtttcttctgcaaaagtacaaaaattaacccactaagaactaaacaggacagggccacggcaaangcagaatggctgccatgttaagacttttgcttgccttatactgatgggtatattttaggngataaaatttctncactatctatccttaaaatgaacattttcttacaacnttattgntaagaactgattttattaantaacaacacnctgggaggnttntggtggctaaaatc

SEQ ID NO: 287 - DNA, 660 bp, Homo sapiens
  misc_feature (540)..(540): n is a, c, g, or t/u
  misc_feature (545)..(545): n is a, c, g, or t/u
  misc_feature (575)..(575): n is a, c, g, or t/u
  misc_feature (614)..(614): n is a, c, g, or t/u
  misc_feature (652)..(652): n is a, c, g, or t/u
cggcggcccagctctctctgacacagttatcaagtgggaatcctgtatatgaaaaatactatagacaggttgatacaggcaatactggaagggtgttggcttctgatgctgctgctttcctgaaaaaatcagggcttccagacttgatacttggaaagatttgggatttagccgacacagatggcaaaggtatcctgaacaaacaagaattctttgttgctttgcgtcttgtggcatgtgcccagaatggattggaagtttcactaagtagtttgaacctggctgttcctccaccaagatttcatgataccagtagtcctttgctaatcagtggaacctctgcagctgagctcccatgggctgtaaaacctgaagataaggccaaatatgatgcaatatttgatagtttaagcccagtgaatggatttctgtctggtgataaagtgaaaccagtgttgctcaactctaagttacctgtggatatccttggaagagtttgggagttgagtgatattgaccatgatggaatgcttgacaganatgantttgcagttgccatgtttttggtatactgngccactgggaaaaagaacctgtgccaatgtccttgcctncagccttgggtgccccccatcttaagaaaaaaaacctnggttggta

SEQ ID NO: 288 - DNA, 815 bp, Homo sapiens
  misc_feature (112)..(112): n is a, c, g, or t/u
  misc_feature (162)..(162): n is a, c, g, or t/u
  misc_feature (595)..(595): n is a, c, g, or t/u
  misc_feature (597)..(597): n is a, c, g, or t/u
  misc_feature (601)..(601): n is a, c, g, or t/u
  misc_feature (623)..(623): n is a, c, g, or t/u
  misc_feature (651)..(651): n is a, c, g, or t/u
  misc_feature (660)..(660): n is a, c, g, or t/u
  misc_feature (666)..(666): n is a, c, g, or t/u
  misc_feature (675)..(675): n is a, c, g, or t/u
  misc_feature (680)..(680): n is a, c, g, or t/u
  misc_feature (705)..(705): n is a, c, g, or t/u
  misc_feature (709)..(709): n is a, c, g, or t/u
  misc_feature (717)..(717): n is a, c, g, or t/u
  misc_feature (733)..(733): n is a, c, g, or t/u
  misc_feature (738)..(738): n is a, c, g, or t/u
  misc_feature (762)..(762): n is a, c, g, or t/u
  misc_feature (785)..(785): n is a, c, g, or t/u
  misc_feature (787)..(787): n is a, c, g, or t/u
  misc_feature (793)..(793): n is a, c, g, or t/u
  misc_feature (799)..(799): n is a, c, g, or t/u
  misc_feature (804)..(804): n is a, c, g, or t/u
gaattggatattttggaatttatttataggctaggcaataagttactcagattaacacagatcaataccaccttgacttgttgacccagagaattctaattagattttaggngcatttttctttatcttggtatttaatacatcatctaagtcagtaaccgngttaaacaaaattaaaatgacaagttacagcttacttcacagtctatttcaaattcagcttgtccactaggtcagttttacaggagatggtcttttaacatgaagaggtctgataatctggcaggtctcttctctcccaattaaaaaaacaagagtttttttgctagcttgacaattttataggtgaaaaacatgaagtgagtaaataaactaaaccacaaagatggacaaaaagcaatatgatataaaacacatcactttttctatttgtattcagtgaaagtttttacatttcaagtaaatgagccttcattaaaaaaaaaaaaacaaatatatatgaaaaattaaagtccttccagttctagcttgctgaagtttcttctgcaaaagtacaaaaattaacccactaagaactaaacaggacagggccccngnaaangcagaatggctgccatgttaanacttttgcttgccttatacctgatgggnatattttangggganaaatttctnccctntctatcacttaaaaggaacattttntttncaactttntttgtaagaaaccggnttttntttattagccaacccccctgggangggtttggtggacctaaaaattntntaaaanccaaanaaaanttttttaaaaa

SEQ ID NO: 289 - DNA, 978 bp, Homo sapiens
  misc_feature (586)..(586): n is a, c, g, or t/u
  misc_feature (629)..(629): n is a, c, g, or t/u
  misc_feature (643)..(643): n is a, c, g, or t/u
  misc_feature (645)..(645): n is a, c, g, or t/u
  misc_feature (652)..(652): n is a, c, g, or t/u
  misc_feature (657)..(657): n is a, c, g, or t/u
  misc_feature (667)..(667): n is a, c, g, or t/u
  misc_feature (669)..(669): n is a, c, g, or t/u
  misc_feature (686)..(686): n is a, c, g, or t/u
  misc_feature (698)..(698): n is a, c, g, or t/u
  misc_feature (746)..(746): n is a, c, g, or t/u
  misc_feature (749)..(750): n is a, c, g, or t/u
  misc_feature (753)..(753): n is a, c, g, or t/u
  misc_feature (771)..(771): n is a, c, g, or t/u
  misc_feature (780)..(780): n is a, c, g, or t/u
  misc_feature (807)..(807): n is a, c, g, or t/u
  misc_feature (816)..(816): n is a, c, g, or t/u
  misc_feature (825)..(825): n is a, c, g, or t/u
  misc_feature (828)..(828): n is a, c, g, or t/u
  misc_feature (832)..(832): n is a, c, g, or t/u
  misc_feature (834)..(834): n is a, c, g, or t/u
  misc_feature (838)..(838): n is a, c, g, or t/u
  misc_feature (850)..(850): n is a, c, g, or t/u
  misc_feature (853)..(853): n is a, c, g, or t/u
  misc_feature (880)..(880): n is a, c, g, or t/u
  misc_feature (885)..(885): n is a, c, g, or t/u
  misc_feature (891)..(891): n is a, c, g, or t/u
  misc_feature (902)..(902): n is a, c, g, or t/u
  misc_feature (905)..(906): n is a, c, g, or t/u
  misc_feature (913)..(913): n is a, c, g, or t/u
  misc_feature (922)..(922): n is a, c, g, or t/u
  misc_feature (943)..(943): n is a, c, g, or t/u
  misc_feature (946)..(946): n is a, c, g, or t/u
  misc_feature (955)..(955): n is a, c, g, or t/u
  misc_feature (963)..(963): n is a, c, g, or t/u
  misc_feature (967)..(967): n is a, c, g, or t/u
  misc_feature (976)..(976): n is a, c, g, or t/u
aggagcttacggtgttccagtcaaaagacgtacctgaaaagacatcatcacctgaagaatccataaggatgacgaaaggcatcaccatggcaacagccaaagccgtggcagctgggaactcatgtagacaggaggacgtgattgctactgccaacctgagccggaaagccgtgtcagatatgttgacggcttgcaagcaagcatccttccaccccgatgtcagtgacgaggtgagaaccagagccttgcgtttcgggacggagtgcacccttggctacttggacctcctggagcacgtcttggtgattcttcagaaaccaaccccagaattcaagcagcagctggccgctttctccaagcgagtcgccggcgctgtgacagagctcatccaggcggcggaagccatgaaaggaacagagtgggtggatccagaagacccaactgtcattgcagaaacagagttactgggggctgcagcatccatcgaagctgctgctaagaagttagagcaactgaagccaagagcaaaaccaaaacaagcgggatgagaccctggacttttgaggaacagatctttggaagctgnttaaatccattgctgctggcacaagcgccctggtcaaatcggnctcagcaaccccananggagctngtggnccaaggaaangngggctccatccttgccnatgcttgaaacnacggacaagtggtcacaaggggcttgattttttgcttgcccggatggnggnnggnttgcaaccagcaattttntgtgaaggngggccaatggccttccgttcaaggggncccccccancgaaggganaancttnantttnatttttgcccancanggtcgcccgttttccacgggtttaaantttgnttgggnggccttgcaanggnngaaaggnccccccccngaatttcaaaaggcccttganggngggtttcanggccgggngggnaaatgcttntg

SEQ ID NO: 290 - DNA, 898 bp, Homo sapiens
  misc_feature (1)..(1): n is a, c, g, or t/u
  misc_feature (32)..(32): n is a, c, g, or t/u
  misc_feature (201)..(201): n is a, c, g, or t/u
  misc_feature (262)..(262): n is a, c, g, or t/u
  misc_feature (303)..(303): n is a, c, g, or t/u
  misc_feature (570)..(570): n is a, c, g, or t/u
  misc_feature (628)..(628): n is a, c, g, or t/u
  misc_feature (637)..(637): n is a, c, g, or t/u
  misc_feature (642)..(642): n is a, c, g, or t/u
  misc_feature (654)..(654): n is a, c, g, or t/u
  misc_feature (659)..(659): n is a, c, g, or t/u
  misc_feature (681)..(681): n is a, c, g, or t/u
  misc_feature (694)..(694): n is a, c, g, or t/u
  misc_feature (715)..(715): n is a, c, g, or t/u
  misc_feature (750)..(751): n is a, c, g, or t/u
  misc_feature (754)..(754): n is a, c, g, or t/u
  misc_feature (760)..(760): n is a, c, g, or t/u
  misc_feature (766)..(766): n is a, c, g, or t/u
  misc_feature (774)..(774): n is a, c, g, or t/u
  misc_feature (778)..(778): n is a, c, g, or t/u
  misc_feature (784)..(784): n is a, c, g, or t/u
  misc_feature (794)..(794): n is a, c, g, or t/u
  misc_feature (804)..(804): n is a, c, g, or t/u
  misc_feature (809)..(809): n is a, c, g, or t/u
  misc_feature (811)..(811): n is a, c, g, or t/u
  misc_feature (831)..(831): n is a, c, g, or t/u
  misc_feature (837)..(837): n is a, c, g, or t/u
  misc_feature (849)..(849): n is a, c, g, or t/u
  misc_feature (866)..(866): n is a, c, g, or t/u
  misc_feature (871)..(871): n is a, c, g, or t/u
  misc_feature (884)..(884): n is a, c, g, or t/u
  misc_feature (895)..(895): n is a, c, g, or t/u
ngagtcactgaggaagctctttattccagcanaatccccaccctggacgctaaggagacgagcattccactgactgtcaactgggagccgtgggtttgtgtggatgactctgtgtgagctgaaacagcctctgcagggtaaggagcccacagactgtattacagcccctgctcaccaagccccgacggccttccgcaactntgccctttggactacggaggaacaaaataatcgttcagttttctgggccacaaaatacaanatgggtctgggttgtacaaggagcttacacacggaggcaanaaagcgtgcaaacaggggcgggaatttttcaccccctgggtgagccagtgctcaagacatggaaggaggacctgagtcaccctcccggagtccacacgggtttgtgtttctggcttttatgaaccatgtccaactccagcttccgtcttctcctgagaggaagaagaatattctatgacgtcaatgatttttttccctatcacaatatcataaagaggtccaggagcaggcctaagagaaggaccaacaaaagccaaagtgtctganaacaacataatactgacttttctttgttggtaacaagtccatgaaacgtgcacccctnttttctganacacngtgaggcatgangggangcggcaaaagaattttgggtangacattttaccgntgacatacgaacattccaccngtgcccacgggacaaaaatgtgaaaacaacccccnnggntttcangcttancccggganggangggggnggtttcactnaatgcccaanccttnangaacactgtttgtccaattnaaccangggcattccctnggggtcgcattttggcntccanctttaacccctanttttccttaanttg

SEQ ID NO: 291 - DNA, 603 bp, Homo sapiens
  misc_feature (78)..(78): n is a, c, g, or t/u
  misc_feature (139)..(139): n is a, c, g, or t/u
  misc_feature (253)..(253): n is a, c, g, or t/u
  misc_feature (578)..(578): n is a, c, g, or t/u
  misc_feature (592)..(592): n is a, c, g, or t/u
aatgcataaagcaggagcttacggtgttccagtcaaaagacgtacctgaaaagacatcatcacctgaagaatccatanggatgacgaaaggcatcaccatggcaacagccaaagccgtggcagctgggaactcatgtanacaggaggacgtgattgctactgccaacctgagccggaaagccgtgtcagatatgttgacggcttgcaagcaagcatccttccaccccgatgtcagtgacgaggtgagaaccanagccttgcgtttcgggacggagtgcacccttggctacttggacctcctggagcacgtcttggtgattcttcagaaaccaaccccagaattcaagcagcagctggccgctttctccaagcgagtcgccggcgctgtgacagagctcatccaggcggcggaagccatgaaaggaacagagtgggtggatccagaagacccaactgtcattgcagaaacagagttactgggggctgcagcatccatcgaagctgcttgctaaaaaagttagagcaactgaagccaagagcaaaaccaaaacaagcggatgagacccttggactttgangaacagatcttggnaactgctaaat

SEQ ID NO: 292 - DNA, 900 bp, Homo sapiens
  misc_feature (627)..(627): n is a, c, g, or t/u
  misc_feature (629)..(629): n is a, c, g, or t/u
  misc_feature (636)..(636): n is a, c, g, or t/u
  misc_feature (641)..(641): n is a, c, g, or t/u
  misc_feature (646)..(646): n is a, c, g, or t/u
  misc_feature (658)..(658): n is a, c, g, or t/u
  misc_feature (704)..(704): n is a, c, g, or t/u
  misc_feature (719)..(719): n is a, c, g, or t/u
  misc_feature (753)..(753): n is a, c, g, or t/u
  misc_feature (757)..(757): n is a, c, g, or t/u
  misc_feature (763)..(763): n is a, c, g, or t/u
  misc_feature (773)..(773): n is a, c, g, or t/u
  misc_feature (783)..(783): n is a, c, g, or t/u
  misc_feature (787)..(787): n is a, c, g, or t/u
  misc_feature (794)..(794): n is a, c, g, or t/u
  misc_feature (822)..(822): n is a, c, g, or t/u
  misc_feature (845)..(845): n is a, c, g, or t/u
  misc_feature (848)..(848): n is a, c, g, or t/u
  misc_feature (860)..(860): n is a, c, g, or t/u
  misc_feature (869)..(869): n is a, c, g, or t/u
  misc_feature (890)..(890): n is a, c, g, or t/u
  misc_feature (894)..(894): n is a, c, g, or t/u
gagtcactgaggaagctctttattccagcagaatccccaccctggacgctaaggagacgagcattccactgactgtcaactgggagccgtgggtttgtgtggatgactctgtgtgagctgaaacagcctctgcagggtaaggagcccacagactgtattacagcccctgctcaccaagccccgacggccttccgcaactctgccctttggactacggaggaacaaaataatcgttcagttttctgggccacaaaatacaagatgggtctgggttgtacaaggagcttacacacggaggcaagaaagcgtgcaaacaggggcgggaatttttcaccccctgggtgagccagtgctcaagacatggaaggaggacctgagtcaccctcccggagtccacacgggtttgtgtttctggcttttatgaaccatgtccaactccagcttccgtcttctcctgagaggaagaagaatattctatgacgtcaatgatttttttccctatcacaatatcataaagaggtccaggagcaggcctaagagaaggaccaacaaaagccaaagtgtctgagaacaacataatactgacttttctttgttggtaacaagtccatgaaacgtgcacccctntnttctganacacngtgangcatgaagggangcggcaaaagaatttgtgggtaagacaattgtacccgtgtgacatnacgaacattccaccnatggcccacggggacaaaaaatgtgaaaacaaancccncagggnttccaggctnaacccggganggangggggcnggtttccaacttaatggcccaacctttnaagaaaacttgtttgtccaattnaanccaggggccatnccctggggnttccccttttgggttccaccnttanccctca

SEQ ID NO: 293 - DNA, 496 bp, Homo sapiens
  misc_feature (288)..(288): n is a, c, g, or t/u
  misc_feature (298)..(298): n is a, c, g, or t/u
  misc_feature (311)..(311): n is a, c, g, or t/u
  misc_feature (327)..(327): n is a, c, g, or t/u
  misc_feature (377)..(377): n is a, c, g, or t/u
  misc_feature (410)..(410): n is a, c, g, or t/u
  misc_feature (419)..(419): n is a, c, g, or t/u
  misc_feature (433)..(433): n is a, c, g, or t/u
  misc_feature (447)..(447): n is a, c, g, or t/u
  misc_feature (465)..(465): n is a, c, g, or t/u
  misc_feature (471)..(471): n is a, c, g, or t/u
  misc_feature (478)..(478): n is a, c, g, or t/u
  misc_feature (489)..(489): n is a, c, g, or t/u
cccctatcgacttccgcgacgtggacatcggcgagctgagcagcgacgtcatctccaacatcgagaccttcgatgtcaacgagtttgaccagtacctgccgcccaacggccacccgggggtgccggccacgcacggccaggtcacctacacgggcagctacggcatcagcagcaccgcggccaccccggcgagcgcgggccacgtgtggatgtccaagcagcaggcgccgccgccacccccgcagcagcccccacaggccccgccggccccgcaggcgcccccgcagncgtaggcggngcccccacagcanccggcggcacccccgnagcagccacaggcgcacactctgaccacgctgagcagctagccgggccantttccagctaacgcacatcaagacggagcaacntgaagcccntagccactacagcnagcagcaagcagcncttgccccaacagatcgnctacangcccttnaaacctttcanactaaag

SEQ ID NO: 294 - DNA, 744 bp, Homo sapiens
  misc_feature (391)..(391): n is a, c, g, or t/u
  misc_feature (570)..(571): n is a, c, g, or t/u
  misc_feature (595)..(595): n is a, c, g, or t/u
  misc_feature (606)..(606): n is a, c, g, or t/u
  misc_feature (615)..(615): n is a, c, g, or t/u
  misc_feature (669)..(669): n is a, c, g, or t/u
  misc_feature (688)..(688): n is a, c, g, or t/u
  misc_feature (703)..(703): n is a, c, g, or t/u
  misc_feature (713)..(713): n is a, c, g, or t/u
  misc_feature (734)..(734): n is a, c, g, or t/u
ggacgctggtgcccatgccggtgcgcgtcaacggctccagcaagaacaagccgcacgtcaagcggcccatgaacgccttcatggtgtgggcgcaggcggcgcgcaggaagctcgcggaccagtacccgcacttgcacaacgccgagctcagcaagacgctgggcaagctctggagacttctgaacgagagcgagaagcggcccttcgtggaggaggcggagcggctgcgcgtgcagcacaagaaggaccacccggattacaagtaccagccgcggcggaggaagtcggtgaagaacgggcaggcggaggcagaggaggccacggagcagacgcacatctcccccaacgccatcttcaaggcgctgcaggccgactcgccacactcctcctncggcatgagcgaggtgcactcccccggcgagcactcggggcaatcccagggcccaccgaccccacccaccacccccaaaaccgacgtgcagccgggcaaggctgacctgaagcgagaggggcgccccttgccagaggggggcagacaagccccctatcgactttcgcgacgtggacatnnggcgagctgagcagcgacgttatnttcaacatttnagaaccttngattgttcaacgaagttttgaccaagttaccttgccgccccaacgggccacccnggggggggcccggccaccncaccgggccaggttnaccttacacngggcaggttaccgggatttanccagcacccg

SEQ ID NO: 295 - DNA, 759 bp, Homo sapiens
  misc_feature (84)..(84): n is a, c, g, or t/u
  misc_feature (238)..(238): n is a, c, g, or t/u
  misc_feature (281)..(281): n is a, c, g, or t/u
  misc_feature (360)..(360): n is a, c, g, or t/u
  misc_feature (499)..(499): n is a, c, g, or t/u
  misc_feature (515)..(515): n is a, c, g, or t/u
  misc_feature (552)..(552): n is a, c, g, or t/u
  misc_feature (594)..(594): n is a, c, g, or t/u
  misc_feature (600)..(600): n is a, c, g, or t/u
  misc_feature (602)..(602): n is a, c, g, or t/u
  misc_feature (630)..(630): n is a, c, g, or t/u
  misc_feature (638)..(638): n is a, c, g, or t/u
  misc_feature (652)..(652): n is a, c, g, or t/u
  misc_feature (656)..(656): n is a, c, g, or t/u
  misc_feature (669)..(669): n is a, c, g, or t/u
  misc_feature (676)..(676): n is a, c, g, or t/u
  misc_feature (698)..(698): n is a, c, g, or t/u
  misc_feature (701)..(701): n is a, c, g, or t/u
  misc_feature (711)..(711): n is a, c, g, or t/u
  misc_feature (731)..(731): n is a, c, g, or t/u
  misc_feature (746)..(746): n is a, c, g, or t/u
  misc_feature (748)..(748): n is a, c, g, or t/u
gtaagagaaagcaaatctgtacaaaaatactctggttgcaagaaaagctagggcacactgttcaactaagagtagtttagctgntggaaaaataagagcatttaattttatctaaaaatatgtataaatcccctcaaaatggtaatgaatcatacacagtacatactaaaaatatttaaaatagagaatattcctcacagaggacttttttctttaattactgctaaaaaaataattncaaagtccaaacaggcagagagatttagcacactgatcacacnattctccatcatcctccacgcttgctctgaagagggtttaaaaagtccagtttctcgttgatttcgctgctccatttanccaaggttggcctggccactgattggccacaagtgggtaatgcgcttggataggtcatgtttgtgtcttggaaatttgggtccgagttgcctttagcttaaatgtctttaaggaagaagaagaagaagaaaaaacaaanccaaaataaaaaaacnaaaaaaacaccaatgtccaaaggggaattctgggttnggtccttctctttcttcgggttattttttagggatcatctcngccatngncgccctttgtggggaggccctcctcaanggtccaantggaaacttgggtntatnaccgggtttgttnccaaatncctgggggggcttggtggggtnttnccggggatgnggaaaggggacccccataanggtgttcgggcccantngggggggtggt

SEQ ID NO: 296 - DNA, 824 bp, Homo sapiens
  misc_feature (626)..(626): n is a, c, g, or t/u
  misc_feature (698)..(698): n is a, c, g, or t/u
  misc_feature (706)..(706): n is a, c, g, or t/u
  misc_feature (711)..(711): n is a, c, g, or t/u
  misc_feature (714)..(714): n is a, c, g, or t/u
  misc_feature (717)..(717): n is a, c, g, or t/u
  misc_feature (722)..(722): n is a, c, g, or t/u
  misc_feature (759)..(759): n is a, c, g, or t/u
  misc_feature (768)..(768): n is a, c, g, or t/u
  misc_feature (795)..(795): n is a, c, g, or t/u
  misc_feature (804)..(804): n is a, c, g, or t/u
  misc_feature (811)..(811): n is a, c, g, or t/u
  misc_feature (817)..(817): n is a, c, g, or t/u
gcggacaccctgaaggtcccggtgctcacttggacatgaactctcttgatagagcccaagcagccaagaataaaggcaataaatattttaaagcaggaaaatatgaacaagctattcagtgctatactgaggctattagcttgtgccctacagagaagaatgttgacctttctacattttatcaaaacagagctgctgcctttgaacagttgcaaaaatggaaagaagtggcacaagactgtacaaaagctgttgaacttaatcccaaatatgtgaaagctctctttagacgtgcaaaagcccatgagaagctagacaataagaaggaatgtttagaagatgtcactgctgtgtgtatattagaagggttccaaaatcaacaaagcatgctgttagcccgataaagttcttaaactccttggaaaagagaaagccaaagaaaaatataagaatcgtgaacctctgatgccatctccacagtttatcaaatcttacttcagttctttcacggatgatatcatttcccacccatgcttaaaggagaaaaatctgatgaagataaagacaagggaaggggaggctttaaaagtgaaagaaaattctggatacttaaaggccaaccagtntatgggaagaagaaaacttccgataaaatcttaagtgaatgctcaaaaagaaataaatgctgaaggccaatncttggcanaagcntgntantaccnactaccttttacctggttattggcatgccatggcagnccaacccanatttaaataaagtcatcaatttgaaanaaacttatngggaacnttcaancaatgct

SEQ ID NO: 297 - DNA, 834 bp, Homo sapiens
  misc_feature (630)..(630): n is a, c, g, or t/u
  misc_feature (663)..(663): n is a, c, g, or t/u
  misc_feature (679)..(679): n is a, c, g, or t/u
  misc_feature (691)..(691): n is a, c, g, or t/u
  misc_feature (753)..(753): n is a, c, g, or t/u
  misc_feature (764)..(764): n is a, c, g, or t/u
  misc_feature (792)..(792): n is a, c, g, or t/u
  misc_feature (801)..(801): n is a, c, g, or t/u
  misc_feature (809)..(809): n is a, c, g, or t/u
gaatgtaatatttatttggtgaatttacatgtgaggtcatttacaaaagaaagatacagacagatgcagctttcagtgcagtttcaaacattttcacaacaggcaatagtccatgagaatttggaatgacagtatagaatggcacatgcttcagtttcctttgtgtttctctacccaaccccaagatgaaagaagggagaagagtagaagaaaatgtcagtgttaatgtaaatacagccatgcaaataaaaacttttttaaagtcagaggtcattcagagatgtagaacatttctgtatttgggggttatcagaaggtgcataatttaaaaacaaaatgcagcggtctcaaacttcccatcatccaaatcatcttgaattatattaactgcaccaactaattagtgacctcctcaatattttccaaagattgactttgaaagggagtcatttctaatagtttctaaaaaagatagcatttgtagacaaatctttttggtttcaacagaattaagcacccttaaggggtgtaaaaatgctcctttactcccaacagtgtaaaccataattataattcgttcttaaataaacctctccccatcctgagtatttcaaaacaaaagacccctgnagaacacacccttcctcccagaaaaattagctntaagccaaagggtggnctataaagtggnaaatgggaataaatcgtaagggattctaagtaagggggggagtaaacttaaccctggcagtnccctagggaanacctggacctgggaggtagtccttaaanaacaaggtngcttactncaaaagccctttaatggtcctcaca

SEQ ID NO: 298 - DNA, 800 bp, Homo sapiens
  misc_feature (587)..(587): n is a, c, g, or t/u
  misc_feature (624)..(624): n is a, c, g, or t/u
  misc_feature (641)..(641): n is a, c, g, or t/u
  misc_feature (699)..(699): n is a, c, g, or t/u
  misc_feature (709)..(709): n is a, c, g, or t/u
  misc_feature (735)..(735): n is a, c, g, or t/u
  misc_feature (770)..(770): n is a, c, g, or t/u
  misc_feature (772)..(772): n is a, c, g, or t/u
  misc_feature (779)..(779): n is a, c, g, or t/u
  misc_feature (786)..(786): n is a, c, g, or t/u
ccccgggcagcggacaccctgaaggtcccggtgctcacttggacatgaactctcttgatagagcccaagcagccaagaataaaggcaataaatattttaaagcaggaaaatatgaacaagctattcagtgctatactgaggctattagcttgtgccctacagagaagaatgttgacctttctacattttatcaaaacagagctgctgcctttgaacagttgcaaaaatggaaagaagtggcacaagactgtacaaaagctgttgaacttaatcccaaatatgtgaaagctctctttagacgtgcaaaagcccatgagaagctagacaataagaaggaatgtttagaagatgtcactgctgtgtgtatattagaagggttccaaaatcaacaaagcatgctgttagccgataaagttcttaaactccttggaaaagagaaagccaaagaaaaatataagaatcgtgaacctctgatgccatctccacagtttatcaaatcttacttcagttctttcacggatgatatcatttcccagcccatgcttaaaggagagaaatctgatgaagataaagacaaggaaggggangctttagaagtgaaaagaaaattctggatacttaaanggccaacagtttatggnagaagaaaactacgataaaatcataagtgaatgctcaaaaaaataaatgctgaaggcnaatacatggnagaagcattggtctacgactaccttntacctggttattggcaatggccatggcggcccaancngatttanataaagncatcagtttggaaa

SEQ ID NO: 299 - DNA, 981 bp, Homo sapiens
gtttatttcttacttgcccgctacatctgctatttggattgtgaaatagtggtcattaggtctgacatactggccataaatattaaatggcttttgtattcactaggaaaacattatggtgtttaattggtgggctcttttttcagaaaaagctgttcatttgcaagaggagctcatagctattaattcaaaaaaggaggaactcaatcaatctgtaaatcgtgtgaaagaacttgagcttgaattagagtctgtcaaagcccagtctttggcaataacaaaacaaaaccatatgctgaatgaaaaggttaaagagatgagtgattattcactactaaaagaagagaaactggagcttctggcacaaaataaattacttaaacaacaactggaagagagtagaaatgaaaacctgcgtctcctaaaccgcctagctcagccggctcctgaacttgcagtctttcagaaagaactacggaaagccgaaaaggctatagtggttgagcatgaggagttcgaaagctgcaggcaagctctgcacaaacaactgcaagacgaaattgagcattctgcacagctgaaggcccagattctaggttacaaagcttctgtaaagagtttaactactcaggttgccgatttaaaattgcaactgaagcaaactcagacagccctagagaatgaagtgtactgcaatccaaagcagtctgtgatcgatcgttctgtcaatggattaataaatggcaatgtggtgccttgcaatggtgagataagtggggatttcttgaacaatccttttaaacaggaaaacgttctagcacgtatgggtgcatcaaggatcacaaattatccaactgcatgggtggagggtagttcccctgattctgaccttgagtttgtagcccaatactaaggcaagggtcaaaagaactttaacaagaaggccgaccccttgggaaaaggctttcaaaagttaccatc

SEQ ID NO: 300 - DNA, 728 bp, Homo sapiens
  misc_feature (598)..(598): n is a, c, g, or t/u
  misc_feature (615)..(615): n is a, c, g, or t/u
  misc_feature (685)..(685): n is a, c, g, or t/u
  misc_feature (694)..(694): n is a, c, g, or t/u
gtcaaagcccagtctttggcaataacaaaacaaaaccatatgctgaatgaaaaggttaaagagatgagtgattattcactactaaaagaagagaaactggagcttctggcacaaaataaattacttaaacaacaactggaagagagtagaaatgaaaacctgcgtctcctaaaccgcctagctcagccggctcctgaacttgcagtctttcagaaagaactacggaaagccgaaaaggctatagtggttgagcatgaggagttcgaaagctgcaggcaagctctgcacaaacaactgcaagacgaaattgagcattctgcacagctgaaggcccagattctaggttacaaagcttctgtaaagagtttaactactcaggttgccgatttaaaattgcaactgaagcaaactcagacagccctagagaatgaagtgtactgcaatccaaagcagtctgtgatcgatcgttctgtcaatggattaataaatggcaatgtggtgccttgcaatggtgagataagtggggatttcttgaacaatccttttaaacaggaaaacgttctagcacgtatgggtgcatcaaggatcacaaattatncaactgcatgggtgganggtagttcccctgattctgaccttgagtttgtagcccaatactaaggcaagggtcaaaagaactttaacnagaaggccnaccccttgggaaaaggctttcaaaagttaccatc

SEQ ID NO: 301 - DNA, 775 bp, Homo sapiens
  misc_feature (529)..(529): n is a, c, g, or t/u
  misc_feature (614)..(614): n is a, c, g, or t/u
  misc_feature (642)..(642): n is a, c, g, or t/u
  misc_feature (704)..(704): n is a, c, g, or t/u
  misc_feature (721)..(722): n is a, c, g, or t/u
  misc_feature (729)..(729): n is a, c, g, or t/u
  misc_feature (743)..(743): n is a, c, g, or t/u
  misc_feature (751)..(751): n is a, c, g, or t/u
ggattacacacatttttattgagttttgtctgatgatagggaaacatttacaaaggagtaaatgttacgtaacttctcacggtatgtaagttagaagctgggcagcaaacatggttaccaagagtcgtctagttcttcatgagaaaagcctgttaaactttcgactttgtcactagattgcagcgtgtccactagggagccttcttggaccatcttttttgagctcttatctgccgactcctggtcttgctcctgctggatgattttcatgtatttctctaaaggattttcactgtgagcagatttgtcttttatttcttgattactcatttctaattcattttccatttctaattccttttttattttaatcttcagtgattcttcaatcatcttcctttcctgatacagtttttctagttctcttcgttccctttctaaaacttcttgtaggttactctgccttctttcttctctctgccttcgttctttcacttgctgttcccgtattttttcttcttccttttgntcttcaatttgtttctgatctacaccttgggtgctgatatgagaggggcacaagcagctgcagcagcgtccacatgagacatatnccccggcaggagaaagcccgcccatttnccaactggccttggcatgttccctgcagaatccaaaaagatgattcaaactcctcatttatnctttaaaagctacttgnnccacatntggaaaaattcacntttgggcntgaaagttcaagtttggcttcgat

SEQ ID NO: 302 - DNA, 696 bp, Homo sapiens
  misc_feature (631)..(631): n is a, c, g, or t/u
gtttatttcttacttgcccgctacatctgctatttggattgtgaaatagtggtcattaggtctgacatactggccataaatattaaatggcttttgtattcactaggaaaacattatggtgtttaattggtgggctcttttttcagaaaaagctgttcatttgcaagaggagctcatagctattaattcaaaaaaggaggaactcaatcaatctgtaaatcgtgtgaaagaacttgagcttgaattagagtctgtcaaagcccagtctttggcaataacaaaacaaaaccatatgctgaatgaaaaggttaaagagatgagtgattattcactactaaaagaagagaaactggagcttctggcacaaaataaattacttaaacaacaactggaagagagtagaaatgaaaacctgcgtctcctaaaccgcctagctcagccggctcctgaacttgcagtctttcagaaagaactacggaaagccgaaaaggctatagtggttgagcatgaggagttcgaaagctgcaggcaagctctgcacaaacaactgcaagacgaaattgagcattctgcacagctgaaggcccagattctaggttacaaagcttctgtaaagagtttaactactcangttgccgatttaaaattgcaactgaagcaaactcagacgccctagagaatggagtgtactgcaat

SEQ ID NO: 303 - DNA, 771 bp, Homo sapiens
  misc_feature (94)..(94): n is a, c, g, or t/u
  misc_feature (143)..(143): n is a, c, g, or t/u
  misc_feature (451)..(451): n is a, c, g, or t/u
  misc_feature (503)..(503): n is a, c, g, or t/u
  misc_feature (540)..(540): n is a, c, g, or t/u
  misc_feature (608)..(608): n is a, c, g, or t/u
  misc_feature (615)..(615): n is a, c, g, or t/u
  misc_feature (619)..(619): n is a, c, g, or t/u
  misc_feature (627)..(627): n is a, c, g, or t/u
  misc_feature (636)..(636): n is a, c, g, or t/u
  misc_feature (671)..(671): n is a, c, g, or t/u
  misc_feature (680)..(680): n is a, c, g, or t/u
  misc_feature (697)..(697): n is a, c, g, or t/u
  misc_feature (739)..(739): n is a, c, g, or t/u
  misc_feature (747)..(748): n is a, c, g, or t/u
  misc_feature (750)..(750): n is a, c, g, or t/u
ggattacacacatttttattgagttttgtctgatgatagggaaacatttacaaaggagtaaatgttacgtaacttctcacggtatgtaagttanaagctgggcagcaaacatggttaccaagagtcgtctagttcttcatganaaaagcctgttaaactttcgactttgtcactagattgcagcgtgtccactagggagccttcttggaccatcttttttgagctcttatctgccgactcctggtcttgctcctgctggatgattttcatgtatttctctaaaggattttcactgtgagcagatttgtcttttatttcttgattactcatttctaattcattttccatttctaattccttttttattttaatcttcagtgattcttcaatcatcttcctttcctgatacagtttttctagttctcttcgttccctttctaaaacttcttgnaggttactctgccttctttccttctctctgccttcggtctttcacttgctgntcccgtattttttcttcttccttttggtcttcaattnggttctgatctacaccttgggtgctgatatgaaaaggggcacagcaactgcagcagcgtccacatganacatatncccnggcagganaaagccccncccttttccaactggcttggcatggttccctggcnattcaaaanaggatccaaccccccantatcctttaaaagctaacttgggccccatttggaaaaatccnctttttgnncntggaagttcaatttggctttc

SEQ ID NO: 304 - DNA, 1489 bp, Homo sapiens
  misc_feature (669)..(669): n is a, c, g, or t/u
  misc_feature (1369)..(1369): n is a, c, g, or t/u
  misc_feature (1399)..(1399): n is a, c, g, or t/u
  misc_feature (1407)..(1407): n is a, c, g, or t/u
  misc_feature (1421)..(1421): n is a, c, g, or t/u
  misc_feature (1425)..(1425): n is a, c, g, or t/u
  misc_feature (1465)..(1465): n is a, c, g, or t/u
  misc_feature (1486)..(1486): n is a, c, g, or t/u
agactattcaccaagtttctttagacttggattcattagcagaaagtcctgaatcagattttatgtctgctgtgaatgagtttgtaatagaagaaaatttgtcgtctcctaatcctataagtgatccacaaagcccagaaatgatggtggaatcactttattcatcagttatcaatgcgatagacagtagacgaatgcaggatacaaatgtatgtggtaaggaggattttggagatcatacttctctgaatgtccagttggaaagatgtagagttgttgcccaagactctcacttcagtatacaaaccattaaggaagacctttgccactttagaacatttgtacaaaaagaacagtgtgacttctcaaattcattaaaatgtacagcagtagaaataagaaacattattgaaaaagtaaaatgttctctggaaataacactaaaagaaaaacatcaaaaagaactactgtctttaaaaaatgaatatgaaggtaaacttgacggactaataaaggaaactgaagagaatgaaaacaaaattaaaaaattgaagggagagttagtatgccttgaggaggttttacaaaataaagataatgaatttgctttggttaaacatgaaaaagaagctgtaatctgcctgcagaatgaaaaggatcagaagttgntagagatggaaaatataatgcactctcaaaattgtgaaattaaagaactgaagcagtcacgagaaatagtgttagaagacttaaaaaagctccatgttgaaaatgatgagaagttacagttattgagggcagaacttcagtccttggagcaaagtcatctaaaggaattagaggacacacttcaggttaggcacatacaagagtttgagaaggttatgacagaccacagagtttctttggaggaattaaaaaaggaaaaccaacaaataattaatcaaatacaagaatctcatgctgaaattatccaggaaaaagaaaaacagttacaggaattaaaactcaaggtttctgatttgtcagacacgagatgcaagttagaggttgaacttgcgttgaaggaagcagaaactgatgaaataaaaattttgctggaagaaagcagagcccagcagaaggagaccttgaaatctcttcttgaacaagagacagaaaatttgagaacagaaattagtaaactcaaccaaaagattcaggataataatgaaaattatcaggtgggcttagcagagctaagaactttaatgacaattgaaaaagatcagtgtatttccgagttaattagtagacatgaagaagaatctaatatacttaaagctgaattaaacaaaagttacatcttttgcattacccaaccttttgnaattgaaaaaaaccttaaagaaccaattanttgactgncgagtaaattgggntcanaaatgggtgctctttgaaggacaaaaggatgaaaaaattnccccccaggaaaaaaaatccnagc

SEQ ID NO: 305 - DNA, 800 bp, Homo sapiens
  misc_feature (604)..(604): n is a, c, g, or t/u
  misc_feature (642)..(642): n is a, c, g, or t/u
  misc_feature (680)..(680): n is a, c, g, or t/u
  misc_feature (710)..(710): n is a, c, g, or t/u
  misc_feature (718)..(718): n is a, c, g, or t/u
  misc_feature (732)..(732): n is a, c, g, or t/u
  misc_feature (736)..(736): n is a, c, g, or t/u
  misc_feature (776)..(776): n is a, c, g, or t/u
  misc_feature (797)..(797): n is a, c, g, or t/u
cactctcaaaattgtgaaattaaagaactgaagcagtcacgagaaatagtgttagaagacttaaaaaagctccatgttgaaaatgatgagaagttacagttattgagggcagaacttcagtccttggagcaaagtcatctaaaggaattagaggacacacttcaggttaggcacatacaagagtttgagaaggttatgacagaccacagagtttctttggaggaattaaaaaaggaaaaccaacaaataattaatcaaatacaagaatctcatgctgaaattatccaggaaaaagaaaaacagttacaggaattaaaactcaaggtttctgatttgtcagacacgagatgcaagttagaggttgaacttgcgttgaaggaagcagaaactgatgaaataaaaattttgctggaagaaagcagagcccagcagaaggagaccttgaaatctcttcttgaacaagagacagaaaatttgagaacagaaattagtaaactcaaccaaaagattcaggataataatgaaaattatcaggtgggcttagcagagctaagaactttaatgacaattgaaaaagatcagtgtatttccgagttaattagtngacatgaagaagaatctaatatacttaaagctgaattnaacaaaagttacatcttttgcattacccaaccttttgnaattgaaaaaaaccttaaagaaccaattanttgactgncgagtaaattgggntcanaaatgggtgctctttgaaggacaaaaggatgaaaaaattnccccccaggaaaaaaaatccnagc

SEQ ID NO: 306 - DNA, 858 bp, Homo sapiens
  misc_feature (669)..(669): n is a, c, g, or t/u
  misc_feature (711)..(711): n is a, c, g, or t/u
  misc_feature (785)..(785): n is a, c, g, or t/u
  misc_feature (800)..(800): n is a, c, g, or t/u
  misc_feature (805)..(805): n is a, c, g, or t/u
  misc_feature (826)..(826): n is a, c, g, or t/u
  misc_feature (830)..(830): n is a, c, g, or t/u
  misc_feature (847)..(847): n is a, c, g, or t/u
  misc_feature (850)..(850): n is a, c, g, or t/u
agactattcaccaagtttctttagacttggattcattagcagaaagtcctgaatcagattttatgtctgctgtgaatgagtttgtaatagaagaaaatttgtcgtctcctaatcctataagtgatccacaaagcccagaaatgatggtggaatcactttattcatcagttatcaatgcgatagacagtagacgaatgcaggatacaaatgtatgtggtaaggaggattttggagatcatacttctctgaatgtccagttggaaagatgtagagttgttgcccaagactctcacttcagtatacaaaccattaaggaagacctttgccactttagaacatttgtacaaaaagaacagtgtgacttctcaaattcattaaaatgtacagcagtagaaataagaaacattattgaaaaagtaaaatgttctctggaaataacactaaaagaaaaacatcaaaaagaactactgtctttaaaaaatgaatatgaaggtaaacttgacggactaataaaggaaactgaagagaatgaaaacaaaattaaaaaattgaagggagagttagtatgccttgaggaggttttacaaaataaagataatgaatttgctttggttaaacatgaaaaagaagctgtaatctgcctgcagaatgaaaaggatcagaagttgntagagatggaaaatataatgccctctcaaaattgggaaattnaagaactgaagcagtcccgagaaatagggttagaagacttaaaaaagctcatgtggaaaatgatgagaagttcnggttttggggggagnacttnagtccttgggccaaagtcttntaanggaatttgaggaccccntcnggttaggc

SEQ ID NO: 307 - DNA, 793 bp, Homo sapiens
  misc_feature (10)..(11): n is a, c, g, or t/u
  misc_feature (13)..(13): n is a, c, g, or t/u
  misc_feature (26)..(26): n is a, c, g, or t/u
  misc_feature (33)..(33): n is a, c, g, or t/u
  misc_feature (48)..(48): n is a, c, g, or t/u
  misc_feature (59)..(59): n is a, c, g, or t/u
  misc_feature (62)..(62): n is a, c, g, or t/u
  misc_feature (83)..(83): n is a, c, g, or t/u
  misc_feature (87)..(87): n is a, c, g, or t/u
  misc_feature (89)..(89): n is a, c, g, or t/u
  misc_feature (96)..(96): n is a, c, g, or t/u
  misc_feature (113)..(113): n is a, c, g, or t/u
  misc_feature (126)..(126): n is a, c, g, or t/u
  misc_feature (128)..(128): n is a, c, g, or t/u
  misc_feature (130)..(130): n is a, c, g, or t/u
  misc_feature (145)..(145): n is a, c, g, or t/u
  misc_feature (150)..(150): n is a, c, g, or t/u
  misc_feature (154)..(154): n is a, c, g, or t/u
  misc_feature (165)..(165): n is a, c, g, or t/u
  misc_feature (167)..(167): n is a, c, g, or t/u
  misc_feature (169)..(169): n is a, c, g, or t/u
  misc_feature (183)..(183): n is a, c, g, or t/u
  misc_feature (193)..(193): n is a, c, g, or t/u
  misc_feature (195)..(195): n is a, c, g, or t/u
  misc_feature (210)..(210): n is a, c, g, or t/u
  misc_feature (225)..(225): n is a, c, g, or t/u
  misc_feature (241)..(241): n is a, c, g, or t/u
  misc_feature (245)..(245): n is a, c, g, or t/u
  misc_feature (248)..(248): n is a, c, g, or t/u
  misc_feature (263)..(263): n is a, c, g, or t/u
  misc_feature (281)..(281): n is a, c, g, or t/u
  misc_feature (300)..(300): n is a, c, g, or t/u
  misc_feature (303)..(303): n is a, c, g, or t/u
  misc_feature (305)..(305): n is a, c, g, or t/u
  misc_feature (311)..(311): n is a, c, g, or t/u
  misc_feature (330)..(330): n is a, c, g, or t/u
  misc_feature (357)..(357): n is a, c, g, or t/u
  misc_feature (361)..(361): n is a, c, g, or t/u
  misc_feature (363)..(363): n is a, c, g, or t/u
  misc_feature (369)..(369): n is a, c, g, or t/u
  misc_feature (377)..(377): n is a, c, g, or t/u
  misc_feature (385)..(385): n is a, c, g, or t/u
  misc_feature (391)..(391): n is a, c, g, or t/u
  misc_feature (403)..(403): n is a, c, g, or t/u
  misc_feature (413)..(413): n is a, c, g, or t/u
  misc_feature (452)..(452): n is a, c, g, or t/u
  misc_feature (475)..(475): n is a, c, g, or t/u
  misc_feature (482)..(482): n is a, c, g, or t/u
  misc_feature (497)..(497): n is a, c, g, or t/u
  misc_feature (500)..(500): n is a, c, g, or t/u
  misc_feature (502)..(502): n is a, c, g, or t/u
  misc_feature (520)..(520): n is a, c, g, or t/u
  misc_feature (522)..(522): n is a, c, g, or t/u
  misc_feature (525)..(525): n is a, c, g, or t/u
  misc_feature (538)..(538): n is a, c, g, or t/u
  misc_feature (550)..(550): n is a, c, g, or t/u
  misc_feature (554)..(554): n is a, c, g, or t/u
  misc_feature (569)..(569): n is a, c, g, or t/u
  misc_feature (573)..(573): n is a, c, g, or t/u
  misc_feature (576)..(576): n is a, c, g, or t/u
  misc_feature (617)..(617): n is a, c, g, or t/u
  misc_feature (621)..(621): n is a, c, g, or t/u
  misc_feature (631)..(631): n is a, c, g, or t/u
  misc_feature (633)..(634): n is a, c, g, or t/u
  misc_feature (636)..(636): n is a, c, g, or t/u
  misc_feature (646)..(646): n is a, c, g, or t/u
  misc_feature (661)..(661): n is a, c, g, or t/u
  misc_feature (670)..(670): n is a, c, g, or t/u
  misc_feature (677)..(677): n is a, c, g, or t/u
  misc_feature (694)..(694): n is a, c, g, or t/u
  misc_feature (705)..(705): n is a, c, g, or t/u
  misc_feature (714)..(714): n is a, c, g, or t/u
  misc_feature (716)..(716): n is a, c, g, or t/u
  misc_feature (732)..(732): n is a, c, g, or t/u
  misc_feature (741)..(741): n is a, c, g, or t/u
  misc_feature (747)..(747): n is a, c, g, or t/u
  misc_feature (751)..(751): n is a, c, g, or t/u
  misc_feature (772)..(772): n is a, c, g, or t/u
  misc_feature (780)..(780): n is a, c, g, or t/u
  misc_feature (783)..(783): n is a, c, g, or t/u
  misc_feature (790)..(790): n is a, c, g, or t/u
ctcttcaagnngntctaaaaacttanctttttnttcctgaagcttttnttgaagttcancanctaagcttgaaaaatctcctntggnanagtcaanggcaggactttttgctntttgattctcaanangnttaactttttctaanaactntttntcaacaacttntntntccaatttaaattnttttagggcngnctgaatagcttcatntttttcacaattaancttctgaattaactgntctntgncttgctcctggctgntgaccaatttttggctgnctttctcaagggtctgganaanancttcgnatttctcttcttggggggnaattttttcatctttttggctttcaanagcncncaattntgaatccnatttactntgcagntcaattatttgntcttttaggnttttttctatttcaaatgcttggttatgcaaagatgttnctttgtttaattcacctttaagnatattanattcttcttcatggnctncnaattaactcggaaatacncnganctttttcaattgncattaaaagttnttanctctgggtaaccccncccnganaaattttcattattatcccggaaccttttgggtggagtttnaccnaaatttccgntnncnaaatttttcntggctctttgggtcnaaaaaaaanaatttcnaggggcccccttttggngggggccttgnttttttttncncccaaaaaatttttantttccaaanaggttntggntttcctttaaaccccaagggntcaacccnttnaccttgncat

SEQ ID NO: 308 - DNA, 584 bp, Homo sapiens
aggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgctcgagttgctaagtccaagttctttgaggacagtgaggatgagtcagatgaagcggaggaagaaaaagaagacagtgaggaatgcagcgaggaaa

SEQ ID NO: 309 - DNA, 809 bp, Homo sapiens
  misc_feature (200)..(200): n is a, c, g, or t/u
  misc_feature (222)..(222): n is a, c, g, or t/u
  misc_feature (302)..(302): n is a, c, g, or t/u
  misc_feature (363)..(363): n is a, c, g, or t/u
  misc_feature (528)..(528): n is a, c, g, or t/u
  misc_feature (590)..(590): n is a, c, g, or t/u
  misc_feature (608)..(608): n is a, c, g, or t/u
  misc_feature (647)..(647): n is a, c, g, or t/u
  misc_feature (708)..(708): n is a, c, g, or t/u
  misc_feature (737)..(737): n is a, c, g, or t/u
  misc_feature (751)..(751): n is a, c, g, or t/u
  misc_feature (757)..(757): n is a, c, g, or t/u
  misc_feature (772)..(772): n is a, c, g, or t/u
  misc_feature (775)..(775): n is a, c, g, or t/u
  misc_feature (790)..(790): n is a, c, g, or t/u
  misc_feature (800)..(800): n is a, c, g, or t/u
  misc_feature (802)..(802): n is a, c, g, or t/u
  misc_feature (806)..(806): n is a, c, g, or t/u
aggttttggcctttagtctgaaaaagtgttgattgaaagtgtacaacagagagcgggtgcaagcggccgagggccatggagccgccaataaaaaagaatgtccttaaataaagttcacagagtaaaaaccagaaccgccagtccttccctccaacacaacagagcacaggcacagaaccggtgatgagcccgaggagcanaggcggctgggaaggacagcanaggctcccggctgcagtgtggagggagagccctctttggaatgggcggagtgaagccacccagctccccctgcacacctnatacccactgctaaggctaaaggaaaaagacaaaactcagtctcaggtccggagggctcanaaaacagtctaggtgggcaggggtctggatgactgctagtctcgcttggccttcttcttcttgtcgctgttgccattttcttcagccccctcagtagagagcacctcctctagttttcgcttgccactctctggctggagctctgctgtgtttcggggcttgaancaaatgatgatgcaggtcatgttgtcacaccctgtaccatccccaaaagtgtctggtgccangcactgatccaacagctnttcacaatggatgacaataccgaacttcccattttcatncgcttggctgatctttgattgaatgaaatctacaactttctgggtggtcatcacattccanatccctccaggcaatgaccatgaattctnggcctcagtgaaantaacanccttgtgtcaggaanggnttgaaatatttgttncttagggggnangttnttg

SEQ ID NO: 310 - DNA, 626 bp, Homo sapiens
  misc_feature (209)..(209): n is a, c, g, or t/u
  misc_feature (591)..(591): n is a, c, g, or t/u
  misc_feature (597)..(597): n is a, c, g, or t/u
  misc_feature (603)..(603): n is a, c, g, or t/u
  misc_feature (606)..(606): n is a, c, g, or t/u
  misc_feature (612)..(612): n is a, c, g, or t/u
tagcggcccagctcaggatggtggacgacggctctgggaaggtggaggtgtggtgcatccaggacttacacaggcagcccgtggaccccaagcgtcatggacagctgtgtgcaggcaactgctaccttgtgctctacacataccagaggctgggccgtgtccagtacatcctgtacctatggcagggccaccaggccactgcggatganattgaggccctgaacagcaacgctgaggaactagatgtcatgtatggtggcgtcctagtacaggagcatgtgaccatgggcagcgagcccccccacttcctcgccatcttccagggccagctggtgatcttccaggagagagctgggcaccatggaaaggggcagtcagcatccaccacaaggcttttccaagtgcaaggcactgacagccacaacaccaggaccatggaggtgccagcccgtgcctcatccctcaactccagtgacatcttcttgctggtcacaagccagcgtctgctacctctggtttgggaagggctgtaatggtgatcaacgtgagatggcacgggtggtggtcactgtcatttccaggaagaatgangaaacngtgctnganggtcangaaccttcccactt

SEQ ID NO: 311 - DNA, 768 bp, Homo sapiens
  misc_feature (26)..(26): n is a, c, g, or t/u
  misc_feature (47)..(47): n is a, c, g, or t/u
  misc_feature (118)..(118): n is a, c, g, or t/u
  misc_feature (211)..(211): n is a, c, g, or t/u
  misc_feature (227)..(227): n is a, c, g, or t/u
  misc_feature (235)..(235): n is a, c, g, or t/u
  misc_feature (237)..(237): n is a, c, g, or t/u
  misc_feature (265)..(265): n is a, c, g, or t/u
  misc_feature (270)..(270): n is a, c, g, or t/u
  misc_feature (300)..(300): n is a, c, g, or t/u
  misc_feature (334)..(334): n is a, c, g, or t/u
  misc_feature (352)..(352): n is a, c, g, or t/u
  misc_feature (402)..(402): n is a, c, g, or t/u
  misc_feature (470)..(470): n is a, c, g, or t/u
  misc_feature (512)..(512): n is a, c, g, or t/u
  misc_feature (562)..(562): n is a, c, g, or t/u
  misc_feature (598)..(598): n is a, c, g, or t/u
  misc_feature (642)..(642): n is a, c, g, or t/u
  misc_feature (645)..(646): n is a, c, g, or t/u
  misc_feature (653)..(653): n is a, c, g, or t/u
  misc_feature (659)..(659): n is a, c, g, or t/u
  misc_feature (680)..(680): n is a, c, g, or t/u
  misc_feature (682)..(682): n is a, c, g, or t/u
  misc_feature (687)..(687): n is a, c, g, or t/u
  misc_feature (702)..(702): n is a, c, g, or t/u
  misc_feature (715)..(715): n is a, c, g, or t/u
  misc_feature (736)..(736): n is a, c, g, or t/u
  misc_feature (743)..(744): n is a, c, g, or t/u
  misc_feature (746)..(746): n is a, c, g, or t/u
  misc_feature (755)..(755): n is a, c, g, or t/u
atgggctgcctgcttttactgacacncagaggatgaccaaaagcctntgaggggagtggaagcagggcctccccagcattgtaggtatgttggggtccaggggataggggcagtcganagggcttgggttcaaaaaaagcccagctgctttttctcctgccgctgcctccacgtggccatgctgtaaaattcctccttggatttcccaaanatatcttggaagtcanagtctgananatagaactccctgcgggcagggtccacnccctntggcaggtcctcaacagcctggtgcatcanttgttcccggcgcaggcccccgttgatcgtggcnctggtgctgctgacgganctgctggttctgctgccagccgacttggggcttcgcaccaaatcattctntgagctgtcctgggagcccttgagggcctgcagggccacggcacctgccctgccattgcccggccatntggatagccccaagttgttgacttctgctgttatctcaaaanatggttgatgctgcttgccgggctgccattcaccactttcttgtgggacnggtggctagtccacttgtaggggtcccaaagtgaanaaccatccaatgaaaggtggggaagctttatggccctgcttgancannaccaatnggtgtngcccgggcttccttcccttgntnggggngaagtctttcaaggntacctccctgggncccaaggccaacccgcctttntttccanntnaattttgcngcttttcccccaa

SEQ ID NO: 312 - DNA, 783 bp, Homo sapiens
  misc_feature (689)..(689): n is a, c, g, or t/u
  misc_feature (734)..(734): n is a, c, g, or t/u
  misc_feature (748)..(748): n is a, c, g, or t/u
  misc_feature (754)..(754): n is a, c, g, or t/u
  misc_feature (780)..(780): n is a, c, g, or t/u
gttatcttgttgctctggacaagttaaatccatacactctatatacttttcggattcgttgttctactgaaactttctggaaatggagcaaatggagcaataaaaaacaacatttaacaacagaagccagtccttcaaaggggcctgatacttggagagagtggagttctgatggaaaaaatttaataatctattggaagcctttacccattaatgaagctaatggaaaaatactttcctacaatgtatcgtgttcatcagatgaggaaacacagtccctttctgaaatccctgatcctcagcacaaagcagagatacgacttgataagaatgactacatcatcagcgtagtggctaaaaattctgtgggctcatcaccaccttccaaaatagcgagtatggaaattccaaatgatgatctcaaaatagaacaagttgttgggatgggaaaggggattctcctcacctggcattacgaccccaacatgacttgcgactacgtcattaagtggtgtaactcgtctcggtcggaaccatgccttatggactggagaaaagttcctcaaacagcactgaaactgtaatagaatctgatgagtttcgaccaggtataagatataattttttcctgtatggatgcagaaatcaaggatatcaattattacgctccatgattggatatatagaanaattggctcccattggtgcccaaatttactggtgaaggatacttntgcagattcgattnttagtnaaaatgggaagacattcctggggaanaac

SEQ ID NO: 313 - DNA, 861 bp, Homo sapiens
  misc_feature (673)..(673): n is a, c, g, or t/u
  misc_feature (711)..(711): n is a, c, g, or t/u
  misc_feature (742)..(742): n is a, c, g, or t/u
  misc_feature (749)..(749): n is a, c, g, or t/u
  misc_feature (751)..(751): n is a, c, g, or t/u
  misc_feature (781)..(781): n is a, c, g, or t/u
  misc_feature (793)..(794): n is a, c, g, or t/u
  misc_feature (797)..(797): n is a, c, g, or t/u
  misc_feature (823)..(823): n is a, c, g, or t/u
  misc_feature (848)..(848): n is a, c, g, or t/u
  misc_feature (859)..(859): n is a, c, g, or t/u
agggatggctctgattggatatatttttcattactgaacatttctatgaactattatatagttttaatatactatgtatgtacaaaatgaattgcatttcattccaaatttccacagatcataaagctcagaaatttagctgaatcctagcagttaaaatcaggattcatacacagagaacctaaatagattttgtcacttgtcactctggcttttttccacaacatggtttttaaaaagatacaatatgagcttcaaaaaaaattaattgatccattatttgcaaatacattacagaatctcagatgataaaaaacaaacaaccaaccaaaaaaaacaaacaaaaaagacatatcttattcggacacttaaaattttcaagtacttttgccttaaatatgaaaaggtaaaatacataggcaacctgagggcagggaaaatacaagatcactttttagtttttccttctgcttttccaagaaccacaatcactccagacatcgcttatgagaaacaagggtgggcagaggatgctgtgctgaaggcaatcaattctgcacagctcaccaagcaattgctgccctgcaacacaggttgcccatggattcagatcagtttatgacagttctaagaaacagcccttgggtactggtcctgtaagaagcattctctntttagttttatatttaaaatgtgaggacgggacaaganatgggggctgaggaaaagactctgagtgggnggacatncnccaaaggggcaaaataccctggcttggggngcaacccacggnntgngctcctcggggggaccaaatccatcnaacttttggccgcttaccccgggtnaaatggttaanag

SEQ ID NO: 314 - DNA, 658 bp, Homo sapiens
  misc_feature (577)..(577): n is a, c, g, or t/u
  misc_feature (615)..(615): n is a, c, g, or t/u
  misc_feature (620)..(621): n is a, c, g, or t/u
  misc_feature (635)..(635): n is a, c, g, or t/u
gttttgtatgtattttttttaaataagtgacaattctaaaattaattttagacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaaganatgattgcaaggatgcaggccccaaatgcagatgccanatgcnnggccggggatggcnatggcggggcttttcgggccacc

SEQ ID NO: 315 - DNA, 852 bp, Homo sapiens
  misc_feature (666)..(666): n is a, c, g, or t/u
  misc_feature (675)..(675): n is a, c, g, or t/u
  misc_feature (698)..(698): n is a, c, g, or t/u
  misc_feature (717)..(717): n is a, c, g, or t/u
  misc_feature (724)..(724): n is a, c, g, or t/u
  misc_feature (738)..(738): n is a, c, g, or t/u
  misc_feature (748)..(748): n is a, c, g, or t/u
  misc_feature (751)..(751): n is a, c, g, or t/u
  misc_feature (769)..(769): n is a, c, g, or t/u
  misc_feature (776)..(776): n is a, c, g, or t/u
  misc_feature (824)..(824): n is a, c, g, or t/u
  misc_feature (846)..(846): n is a, c, g, or t/u
aatatctaaacaatagtgctttattgataaaaggttagtttaaatggatacaaaattgctgtgtaaaataagtgttttcaaaatacatttctataggtagagactatgtcttagtaaaagagcagttatctattatcaaaagtatctatttagatttgggtagtaaaaccaaaggggatcagaagtgtagcagtgtgggtcctccctccctgcatagctgttaccaggaggcagcgtgcctgaagtactttcactcacatatgcggggcttagtcactagcaaacttgtttttcttttttacagattttccagcaaagttattaaatgtcaaactcaaataatggactccgcatggatgtactctgaagtcatggaacaccacttcttagttaccttcacacaataagccataacatatagcttttggctgttcacaattaaacaacagtgaagggcaaagttagcaagaacaccagattattttctgtagcacaccttcattaactattattatttaactgcctcattttatggtttttctagcccccacaaaaatgaaaaaaccctgtctcatcctcaaattaagcattttctccatcttcctacacaaccattggctcctttcatctggcaatttctggggggtgaatttcccacttcagtanaaatggatnaaaaaaggcacccgctggagtgntcccttaggggaccccaanaaaaaanggggacccttaggnttccggggcncanaaaaacaaaaccaggggngggtttnaatggggcggacctggccccttaccctttgctacaaaatttgaaaagngttttcccttttgacctggccncccggg

SEQ ID NO: 316 - DNA, 660 bp, Homo sapiens
gagagagagagtgacccagtcagcgttggttcccgtcttggccatggcctcgttcgtgacagaagttttggcacactccgggaggctggaaaaggaggatctggggacccggatcagccgcctgacccggcgggtggaggagatcaagggtgaggtgtgcaatatgattagcaagaagtacagtgaattcctgcctagcatgcagagcgcgcagggcctgattacccaggtggataagctatctgaagacattgacctgctgaaatccaggatagagagtgaggtccgccgggatcttcacgtatcaaccggtgaatttacagacttaaagcagcagttggaaagagactcagttgtcctaagtttgcttaaacagttgcaggagttttccactgctattgaagaatataattgtgcattaacagagaagaagtatgtcactggtgctcagcgtctggaagaggcacagaaatgcttgaagttattaaaatccagaaaatgctttgatttaaaaatattgaaatctctcagcatggagctcacaatacaggaaacagaacatactttatcaccttggagaagagtggcagaagctgattgtatggaagttcccaccatcaaaagataccagccagtttgggaatctttaccttacaaact

SEQ ID NO: 317 - DNA, 773 bp, Homo sapiens
  misc_feature (71)..(71): n is a, c, g, or t/u
  misc_feature (127)..(127): n is a, c, g, or t/u
  misc_feature (448)..(448): n is a, c, g, or t/u
  misc_feature (588)..(588): n is a, c, g, or t/u
  misc_feature (606)..(606): n is a, c, g, or t/u
  misc_feature (612)..(612): n is a, c, g, or t/u
  misc_feature (637)..(637): n is a, c, g, or t/u
  misc_feature (706)..(706): n is a, c, g, or t/u
  misc_feature (731)..(731): n is a, c, g, or t/u
  misc_feature (755)..(755): n is a, c, g, or t/u
  misc_feature (769)..(769): n is a, c, g, or t/u
gtaaaaagcaatatttattggaaagaaatattacaggaagtctccttaattcctgtaaggccaaatatggnggcccattcctcccttcccctcctccacacccctaaaatatctccgatttgctcanaaattctctaccctgactcctggaatctcccaattcctcgttccaaagctagggcctgcatttacaatgtatatagctcccagagggctctggaagcagcatgaaataatgctgcctgacagtttgttagctaatcaaaggaagatggctagaaagtcaatgaattgaggtgctttacttgacaatttatcttaataaacagttcttaaacaaagcctcgtacaggccaggaggtaagacgttcttctgtaaagtcaaacttccaagatgtactggttcaccaaaaccaatgggcgattcaaagaagtctttaagggagtnattatgccaagggaagaatccacatattcaagacatagctttcttaagaagatggagctatttaattttagcaagggcagctgctcttcttttctgtgtctgaaacaaggccgaattaaagctttacttcactggaaganaacgcactgccaggggtncttttncatctggcccaccgaccccaatttnttgccaagctggctttgggagccatcatcatcaaattccttggaatggcttccatttttggcacattanactggaaacctcttcttgaaatttnctggtgcttggctttcttcaaaanaaaaggggcaaatncctt

SEQ ID NO: 318 - DNA, 668 bp, Homo sapiens
gccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaaacccccagctcaccttctaaatccccagccttcttttgagatcccagccagtgctattggaagccaatggagtggaccgggat

SEQ ID NO: 319 - DNA, 750 bp, Homo sapiens
  misc_feature (5)..(5): n is a, c, g, or t/u
  misc_feature (10)..(10): n is a, c, g, or t/u
  misc_feature (12)..(12): n is a, c, g, or t/u
  misc_feature (14)..(14): n is a, c, g, or t/u
  misc_feature (17)..(18): n is a, c, g, or t/u
  misc_feature (20)..(20): n is a, c, g, or t/u
  misc_feature (23)..(23): n is a, c, g, or t/u
  misc_feature (26)..(26): n is a, c, g, or t/u
  misc_feature (31)..(32): n is a, c, g, or t/u
  misc_feature (43)..(43): n is a, c, g, or t/u
  misc_feature (45)..(45): n is a, c, g, or t/u
  misc_feature (55)..(55): n is a, c, g, or t/u
  misc_feature (59)..(59): n is a, c, g, or t/u
  misc_feature (70)..(70): n is a, c, g, or t/u
  misc_feature (73)..(73): n is a, c, g, or t/u
  misc_feature (77)..(78): n is a, c, g, or t/u
  misc_feature (83)..(84): n is a, c, g, or t/u
  misc_feature (88)..(89): n is a, c, g, or t/u
  misc_feature (93)..(93): n is a, c, g, or t/u
  misc_feature (96)..(96): n is a, c, g, or t/u
  misc_feature (101)..(104): n is a, c, g, or t/u
  misc_feature (106)..(106): n is a, c, g, or t/u
  misc_feature (110)..(110): n is a, c, g, or t/u
  misc_feature (115)..(115): n is a, c, g, or t/u
  misc_feature (117)..(117): n is a, c, g, or t/u
  misc_feature (123)..(123): n is a, c, g, or t/u
  misc_feature (126)..(126): n is a, c, g, or t/u
  misc_feature (130)..(130): n is a, c, g, or t/u
  misc_feature (135)..(135): n is a, c, g, or t/u
  misc_feature (138)..(138): n is a, c, g, or t/u
  misc_feature (143)..(143): n is a, c, g, or t/u
  misc_feature (145)..(145): n is a, c, g, or t/u
  misc_feature (148)..(149): n is a, c, g, or t/u
  misc_feature (153)..(153): n is a, c, g, or t/u
  misc_feature (157)..(157): n is a, c, g, or t/u
  misc_feature (160)..(162): n is a, c, g, or t/u
  misc_feature (164)..(164): n is a, c, g, or t/u
  misc_feature (175)..(178): n is a, c, g, or t/u
  misc_feature (183)..(183): n is a, c, g, or t/u
  misc_feature (188)..(188): n is a, c, g, or t/u
  misc_feature (190)..(190): n is a, c, g, or t/u
  misc_feature (192)..(192): n is a, c, g, or t/u
  misc_feature (200)..(200): n is a, c, g, or t/u
  misc_feature (211)..(211): n is a, c, g, or t/u
  misc_feature (247)..(247): n is a, c, g, or t/u
  misc_feature (259)..(259): n is a, c, g, or t/u
  misc_feature (271)..(273): n is a, c, g, or t/u
  misc_feature (281)..(282): n is a, c, g, or t/u
  misc_feature (289)..(289): n is a, c, g, or t/u
  misc_feature (326)..(326): n is a, c, g, or t/u
  misc_feature (331)..(331): n is a, c, g, or t/u
  misc_feature (333)..(333): n is a, c, g, or t/u
  misc_feature (336)..(336): n is a, c, g, or t/u
  misc_feature (338)..(338): n is a, c, g, or t/u
  misc_feature (354)..(354): n is a, c, g, or t/u
  misc_feature (364)..(365): n is a, c, g, or t/u
  misc_feature (374)..(374): n is a, c, g, or t/u
  misc_feature (380)..(381): n is a, c, g, or t/u
  misc_feature (383)..(383): n is a, c, g, or t/u
  misc_feature (386)..(386): n is a, c, g, or t/u
  misc_feature (402)..(403): n is a, c, g, or t/u
  misc_feature (409)..(409): n is a, c, g, or t/u
  misc_feature (413)..(413): n is a, c, g, or t/u
  misc_feature (418)..(418): n is a, c, g, or t/u
  misc_feature (441)..(442): n is a, c, g, or t/u
  misc_feature (447)..(447): n is a, c, g, or t/u
  misc_feature (451)..(451): n is a, c, g, or t/u
  misc_feature (473)..(473): n is a, c, g, or t/u
  misc_feature (477)..(477): n is a, c, g, or t/u
  misc_feature (491)..(491): n is a, c, g, or t/u
  misc_feature (497)..(497): n is a, c, g, or t/u
  misc_feature (516)..(516): n is a, c, g, or t/u
  misc_feature (519)..(519): n is a, c, g, or t/u
  misc_feature (534)..(534): n is a, c, g, or t/u
  misc_feature (540)..(540): n is a, c, g, or t/u
  misc_feature (548)..(548): n is a, c, g, or t/u
  misc_feature (564)..(564): n is a, c, g, or t/u
  misc_feature (570)..(570): n is a, c, g, or t/u
  misc_feature (572)..(572): n is a, c, g, or t/u
  misc_feature (575)..(575): n is a, c, g, or t/u
  misc_feature (578)..(578): n is a, c, g, or t/u
  misc_feature (592)..(592): n is a, c, g, or t/u
  misc_feature (600)..(600): n is a, c, g, or t/u
  misc_feature (619)..(619): n is a, c, g, or t/u
  misc_feature (621)..(621): n is a, c, g, or t/u
  misc_feature (630)..(630): n is a, c, g, or t/u
  misc_feature (635)..(635): n is a, c, g, or t/u
  misc_feature (637)..(638): n is a, c, g, or t/u
  misc_feature (642)..(642): n is a, c, g, or t/u
  misc_feature (649)..(649): n is a, c, g, or t/u
  misc_feature (663)..(663): n is a, c, g, or t/u
  misc_feature (675)..(675): n is a, c, g, or t/u
  misc_feature (677)..(677): n is a, c, g, or t/u
  misc_feature (681)..(681): n is a, c, g, or t/u
  misc_feature (685)..(685): n is a, c, g, or t/u
  misc_feature (693)..(693): n is a, c, g, or t/u
  misc_feature (703)..(704): n is a, c, g, or t/u
  misc_feature (706)..(706): n is a, c, g, or t/u
  misc_feature (710)..(710): n is a, c, g, or t/u
  misc_feature (722)..(722): n is a, c, g, or t/u
  misc_feature (729)..(729): n is a, c, g, or t/u
  misc_feature (739)..(739): n is a, c, g, or t/u
attantgtcntntnccnnantantgnatacnnggaacatcatntngatttgcaanggancccagtgggancanaggnnaaatnnaaanngganccngcacnnnntnctgnagaancngatccncancganggccntancatgngnggnncctnagtnaannncntttgcatgacnnnntgctntctcncnanttggcaantcgtatggatnaggcaggcggagagcgcctgtctattaattcatgantgcatgaatcgncctgccttgctnnngtactccnntcgcagntgctccttccgcaacgctggcctggtgggcggcttgntcctncnggncnttgcctccaacctgancaatgtcacnnttgcccctntccagnntnacntccgggtgcaccttcnnggcctngtanctttnctcctccttcttcgactcgggannacgcntgantgcgaacacacattcacacacntttnaattcttgctgaanccttanacagaacgggacccatctnaanaatatcttctataanaggtcngccaagancactttttcaccggantttaangnttngtnaacggcttgccttntttttacnaaaaccaagcttggttgancnccctttggnggggnannactnacttttntttcttggggaccnacccctttattnantatnaaancaatgggnccttttccannanttcnggccaatttttntaccttnaattttccancacctttacca

SEQ ID NO: 320 - DNA, 694 bp, Homo sapiens
  misc_feature (660)..(660): n is a, c, g, or t/u
gctgcagcggctttttgaggaattccgggactcagatgatgtcctgggtcatatcatgaagaatatcacagccaaacgctcacgggcccgaatagtggataaactcttggctctggggctggtggctgagcggcgggagctgtacaagaaacggcagaaaaagttggcatcctccatcttgccaaatggagcggagtccctgaaagatttttgccaggaagatctggaagaagaggaaaacctgcctgaggaagacagcgaagaggaagaagaagggggctcagaagcagaacaagtccagggtagcttagtcctttcaaatgaaaaccttggtcaaagcctgcatcaggaaggcttttctatcccgctcctatggctccagaactgcctgatccgagcagctgatgatcgggaagaggatggctgctcccaggccgttccattggtgccactcacagaggaaaatgaggaagccatggaaaacgaacagtttcagcagctgttgcgcaagctaggggttcggccccctgcctctgggcaggaaaccttctggcgaattccagccaagctgagtcctacccagctccggagggcagcagcttcttttgagtcaaccagaggaggaacagaaacttgcagccagaactgcagcctaaagtncctggagagcaaggctctgatgaagagcacttgt

SEQ ID NO: 321 - DNA, 798 bp, Homo sapiens
  misc_feature (38)..(38): n is a, c, g, or t/u
  misc_feature (49)..(49): n is a, c, g, or t/u
  misc_feature (52)..(52): n is a, c, g, or t/u
  misc_feature (61)..(61): n is a, c, g, or t/u
  misc_feature (74)..(74): n is a, c, g, or t/u
  misc_feature (95)..(95): n is a, c, g, or t/u
  misc_feature (104)..(104): n is a, c, g, or t/u
  misc_feature (109)..(109): n is a, c, g, or t/u
  misc_feature (147)..(147): n is a, c, g, or t/u
  misc_feature (152)..(152): n is a, c, g, or t/u
  misc_feature (154)..(154): n is a, c, g, or t/u
  misc_feature (157)..(157): n is a, c, g, or t/u
  misc_feature (164)..(164): n is a, c, g, or t/u
  misc_feature (205)..(205): n is a, c, g, or t/u
  misc_feature (209)..(209): n is a, c, g, or t/u
  misc_feature (228)..(228): n is a, c, g, or t/u
  misc_feature (230)..(230): n is a, c, g, or t/u
  misc_feature (268)..(268): n is a, c, g, or t/u
  misc_feature (276)..(276): n is a, c, g, or t/u
  misc_feature (293)..(293): n is a, c, g, or t/u
  misc_feature (324)..(324): n is a, c, g, or t/u
  misc_feature (343)..(343): n is a, c, g, or t/u
  misc_feature (345)..(345): n is a, c, g, or t/u
  misc_feature (359)..(359): n is a, c, g, or t/u
  misc_feature (361)..(361): n is a, c, g, or t/u
  misc_feature (393)..(393): n is a, c, g, or t/u
  misc_feature (401)..(401): n is a, c, g, or t/u
  misc_feature (412)..(412): n is a, c, g, or t/u
  misc_feature (460)..(460): n is a, c, g, or t/u
  misc_feature (491)..(491): n is a, c, g, or t/u
  misc_feature (539)..(539): n is a, c, g, or t/u
  misc_feature (544)..(544): n is a, c, g, or t/u
  misc_feature (556)..(556): n is a, c, g, or t/u
  misc_feature (589)..(589): n is a, c, g, or t/u
  misc_feature (603)..(603): n is a, c, g, or t/u
  misc_feature (614)..(614): n is a, c, g, or t/u
  misc_feature (621)..(621): n is a, c, g, or t/u
  misc_feature (633)..(633): n is a, c, g, or t/u
  misc_feature (663)..(663): n is a, c, g, or t/u
  misc_feature (665)..(665): n is a, c, g, or t/u
  misc_feature (694)..(694): n is a, c, g, or t/u
  misc_feature (697)..(697): n is a, c, g, or t/u
  misc_feature (700)..(700): n is a, c, g, or t/u
  misc_feature (714)..(714): n is a, c, g, or t/u
  misc_feature (717)..(718): n is a, c, g, or t/u
  misc_feature (720)..(720): n is a, c, g, or t/u
  misc_feature (735)..(735): n is a, c, g, or t/u
  misc_feature (749)..(749): n is a, c, g, or t/u
  misc_feature (764)..(764): n is a, c, g, or t/u
  misc_feature (768)..(768): n is a, c, g, or t/u
  misc_feature (778)..(778): n is a, c, g, or t/u
  misc_feature (784)..(784): n is a, c, g, or t/u
  misc_feature (789)..(789): n is a, c, g, or t/u
  misc_feature (793)..(793): n is a, c, g, or t/u
ctaatcttacatgtttaataccaaacacaaagcaaacncattcatcatntanagtactatnttccaaccctatntcaaatgcaggaatgggcctntatctggtntctanaggatgatcataggaaacaaaatgaggacagaggcatntggtntnttntaaaagnggtacaaaactcccgcctgtcatgtcataaagctccccatntggngctgcgacccacctccaananaaagccaaaggaacagaccaataaaaggggtccggggngctttctntatttcactcactcctnttatttgctaaggagctccaataaccaaaanaaatggttcctaaaaaaananaactaaatctccananagctgctggggcataccgataaaaactggganaaacaaanactgacagcanaaaagtccaatactgctgctgaagtttctcagcctaaatccgtgaaanagcctgggattctactgctctgtccagtaanaggagcttctgggtcctgtatgacccttccaactctgacttgaatgcnccatntaaaaacgtgtntatttctacccctagggcttttttagctttttnagtcatcctcaatnattccctcaantctgggnattcggttcttnttttgggattcctgggaacctccccaactntngggggctcttgttccctgccccttaattnttnttncttggtccctcggncgnntntcccaacaaatttgnccgttttttggggnggcttccctttaagngggnttttttaccnaacaangggtntttnctccc

SEQ ID NO: 322 - DNA, 1120 bp, Homo sapiens
  misc_feature (2)..(2): n is a, c, g, or t/u
  misc_feature (9)..(9): n is a, c, g, or t/u
  misc_feature (623)..(623): n is a, c, g, or t/u
  misc_feature (665)..(665): n is a, c, g, or t/u
  misc_feature (683)..(683): n is a, c, g, or t/u
  misc_feature (696)..(696): n is a, c, g, or t/u
  misc_feature (702)..(702): n is a, c, g, or t/u
  misc_feature (834)..(834): n is a, c, g, or t/u
  misc_feature (843)..(843): n is a, c, g, or t/u
  misc_feature (862)..(862): n is a, c, g, or t/u
  misc_feature (875)..(875): n is a, c, g, or t/u
cnagctttnctcgcgcgcctgcaggtcgacactagtggatccaaagtttgagacgattgtggagcaggccccgcttgccattgaagacctcctgaatgaactggacacacaggatgaggaggtggcgtcggacagtgatgagtcctctgagggtggtgagcgtggagacgcgctgtcccagaagaggtctgagaagccgcccgcaggctccatctgcagggctgaacctgaggctggtgaggagcaggcaggtgacgacagggacagtggcggccccgttctccagtttgactacgaggcagttgctaacagactgtttgaaatggccagccgccagagcaccccttctcagaacagaaagcgtctctacaaagtgatccggaagctgcaggacctggcaggaggcattttccctgaagatgagatcccagagaaggcctgcaggcgcctgcttgaagggaggcggcagaagaagacgaagaagcagaagcgtctgctcaggttgcagcaggagagagggaaaggtgagaaggagcccccgagcccgggcatggagaggaagaggagcaggaggaggggtgtaggggcccgaccccgaggcgcgggcagaggctggtgagcanccaggcacagctgagcgggccctgcttccgagatcagcccangggcccgtggccagaaangggctcgccaganaaggangacaccttcggcccctgaccagtgcccgagcaaaggcggccaatgtccaggagccggagaagaagaagaaacgcagggagtgatgtggccgggccaaggacaggcagggagggaggccaggcctcgcttgcnccgcgggangaggctgaccgggctgttntgtagactcaggnccgtggctccagaactcctgtgccaggcgggagggaagggcggcactggagagatgggcccatcattaggggccagcatcccaggaactggacctttccccagagcctccgcctgtggctgtgatgaccttgggccagaaggtcaaactccgaagactgaaactctgcctgcagcaggactggctgcccctgctgtggggggttcagaaaataaaatgccgcgcagcccttgccagggaagtgtc

SEQ ID NO: 323 - DNA, 695 bp, Homo sapiens
  misc_feature (577)..(577): n is a, c, g, or t/u
  misc_feature (619)..(619): n is a, c, g, or t/u
  misc_feature (637)..(637): n is a, c, g, or t/u
  misc_feature (650)..(650): n is a, c, g, or t/u
  misc_feature (656)..(656): n is a, c, g, or t/u
tttgagacgattgtggagcaggccccgcttgccattgaagacctcctgaatgaactggacacacaggatgaggaggtggcgtcggacagtgatgagtcctctgagggtggtgagcgtggagacgcgctgtcccagaagaggtctgagaagccgcccgcaggctccatctgcagggctgaacctgaggctggtgaggagcaggcaggtgacgacagggacagtggcggccccgttctccagtttgactacgaggcagttgctaacagactgtttgaaatggccagccgccagagcaccccttctcagaacagaaagcgtctctacaaagtgatccggaagctgcaggacctggcaggaggcattttccctgaagatgagatcccagagaaggcctgcaggcgcctgcttgaagggaggcggcagaagaagacgaagaagcagaagcgtctgctcaggttgcagcaggagagagggaaaggtgagaaggagcccccgagcccgggcatggagaggaagaggagcaggaggaggggtgtaggggcccgaccccgaggcgcgggcagaggctggtgagcanccaggcacagctgagcgggccctgcttccgagatcagcccangggcccgtggccagaaangggctcgccaganaaggangacaccttcggcccctgaccagtgcccgagccaaaaggc

SEQ ID NO: 324 - DNA, 630 bp, Homo sapiens
  misc_feature (246)..(246): n is a, c, g, or t/u
  misc_feature (259)..(259): n is a, c, g, or t/u
  misc_feature (278)..(278): n is a, c, g, or t/u
  misc_feature (287)..(287): n is a, c, g, or t/u
  misc_feature (485)..(485): n is a, c, g, or t/u
  misc_feature (511)..(511): n is a, c, g, or t/u
  misc_feature (564)..(564): n is a, c, g, or t/u
  misc_feature (600)..(600): n is a, c, g, or t/u
  misc_feature (607)..(607): n is a, c, g, or t/u
  misc_feature (616)..(616): n is a, c, g, or t/u
gacacttccctggcaagggctgcgcggcattttattttctgaaccccccacagcaggggcagccagtcctgctgcaggcagagtttcagtcttcggagtttgaccttctggcccaaggtcatcacagccacaggcggaggctctggggaaaggtccagttcctgggatgctggcccctaatgatgggcccatctctccagtgccgcccttccctcccgcctggcacaggagttctggagccacggncctgagtctacanaacagcccggtcagcctcntcccgcggngcaagcgaggcctggcctccctccctgcctgtccttggcccggccacatcactccctgcgtttcttcttcttctccggctcctggacattggccgcctttgctcgggcactggtcaggggccgaggtgtcctccttcttctggcgagcccctctttggccacggcccctgggctgatctcggagcagggcccgctcanctgtgcctggctgttcaccaaacctnttgcccgcgcctcgggggtcgggcccctaacaccccttcctcctgggtacctntttcctcttcatgccccggggcttcgggggggcctnctttttnacccttttncctttttttccctg

SEQ ID NO: 325 - DNA, 675 bp, Homo sapiens
  misc_feature (624)..(624): n is a, c, g, or t/u
gtagtgaagaaaccctgcccaaggccaaccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacaggtgagtgggatgggagagatgggataatcaaccataaacctttggtgagctcttttacagtttcacttaaggcttctactccatttactcattcacatatttaagcaaggggctgctgtgtgtcaaatattaaggcttgtgcttgatctgtggaaccaacagacaggtttccttcttnttcctgcaagttttacatttctttggggtggtggaaaaagttttggattgt

SEQ ID NO: 326 - DNA, 866 bp, Homo sapiens
  misc_feature (450)..(450): n is a, c, g, or t/u
  misc_feature (475)..(475): n is a, c, g, or t/u
  misc_feature (568)..(568): n is a, c, g, or t/u
  misc_feature (576)..(576): n is a, c, g, or t/u
  misc_feature (602)..(602): n is a, c, g, or t/u
  misc_feature (637)..(637): n is a, c, g, or t/u
  misc_feature (673)..(673): n is a, c, g, or t/u
  misc_feature (694)..(694): n is a, c, g, or t/u
  misc_feature (696)..(696): n is a, c, g, or t/u
  misc_feature (716)..(716): n is a, c, g, or t/u
  misc_feature (724)..(724): n is a, c, g, or t/u
  misc_feature (728)..(728): n is a, c, g, or t/u
  misc_feature (750)..(750): n is a, c, g, or t/u
  misc_feature (757)..(757): n is a, c, g, or t/u
  misc_feature (770)..(770): n is a, c, g, or t/u
  misc_feature (800)..(800): n is a, c, g, or t/u
  misc_feature (815)..(815): n is a, c, g, or t/u
  misc_feature (819)..(819): n is a, c, g, or t/u
  misc_feature (825)..(825): n is a, c, g, or t/u
  misc_feature (832)..(832): n is a, c, g, or t/u
gcggctccttccagagcagggctaactcctacgcagtgtgcccagagtcagcctgttttttttcaatatcttcacgtcatccaatcttcttttcctttaaaaacctacttgtgggctggttgtggtggcttgcacctgtaatcccagcactttgcgaggtcaaggcaggaagattgctgaagcccagcagtttgagaccagcctgggcaacatagtgaaactgtcttcaaaaacaaaacaaaacaaacaaaaaaaaccctacttataactgctgctaatcagagtgtattttcacggcaacttgaatctttgctcctaaaggctgtcctcaaaacctgaccaaatatactttacttaatgttaagtttgcctcagttttttcctttaggtcaacaataggtatgacccaagaaccctagaacttggtcataaagcttctggtgcccttgncacttccctcctctattatttctgnggccctcatctcctttcccactgggattcccaggaaaaactttacaaatagagcagtgacagatgagttccccaagggcttgctttgaggtanaaaggaanagtggtttgaaattcccttaccttgncattatcataagaagtaattaagacattaactatntaattgactctttaacatcaacttttaccacccaanaatgtaaacctgcaggaaganangacctgttgttggttccaanatcaagcncagnctaatttttgacacacagcaancccttgntttaaatatgggnattgagtaaatggagtaaaaacctttaagngaaactgtaaaaaanctcnccaaanggttatngggtggatattccattttttccatcccattacct

SEQ ID NO: 327 - DNA, 884 bp, Homo sapiens
  misc_feature (572)..(572): n is a, c, g, or t/u
  misc_feature (575)..(575): n is a, c, g, or t/u
  misc_feature (596)..(596): n is a, c, g, or t/u
  misc_feature (603)..(603): n is a, c, g, or t/u
  misc_feature (640)..(640): n is a, c, g, or t/u
  misc_feature (669)..(669): n is a, c, g, or t/u
  misc_feature (702)..(702): n is a, c, g, or t/u
  misc_feature (709)..(709): n is a, c, g, or t/u
  misc_feature (711)..(711): n is a, c, g, or t/u
  misc_feature (726)..(726): n is a, c, g, or t/u
  misc_feature (734)..(734): n is a, c, g, or t/u
  misc_feature (738)..(738): n is a, c, g, or t/u
  misc_feature (766)..(766): n is a, c, g, or t/u
  misc_feature (768)..(768): n is a, c, g, or t/u
  misc_feature (778)..(778): n is a, c, g, or t/u
  misc_feature (791)..(791): n is a, c, g, or t/u
  misc_feature (806)..(806): n is a, c, g, or t/u
  misc_feature (817)..(817): n is a, c, g, or t/u
  misc_feature (821)..(821): n is a, c, g, or t/u
  misc_feature (845)..(845): n is a, c, g, or t/u
  misc_feature (870)..(870): n is a, c, g, or t/u
agaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagccgtgaaggaagaaaatgaaaggctgcagaaagaaggcagcgagaaggagagaccaaccagcagctgatccangangtccgctgcagcggccagganctgacanggtgcaggaggagctgaagttgaggcagcagctgctntacagaatgacaagcttttgcagtctttncgagtggagctgaaggcgtatgaaaagctgggntgaaaancncaggaaacttgaaanaggcgtcngganaaaggcttgaaaggggcaggatcctttnanggacctggcncagccttctggtngggaaaaccaggctnttgggcttggnactntgaaaggggcctttgaaacccgcngcccttttggaaaacaaggtttaanggacaacttgggca

SEQ ID NO: 328 - DNA, 1005 bp, Homo sapiens
  misc_feature (4)..(4): n is a, c, g, or t/u
  misc_feature (323)..(323): n is a, c, g, or t/u
  misc_feature (533)..(533): n is a, c, g, or t/u
  misc_feature (539)..(539): n is a, c, g, or t/u
  misc_feature (576)..(576): n is a, c, g, or t/u
  misc_feature (579)..(579): n is a, c, g, or t/u
  misc_feature (581)..(581): n is a, c, g, or t/u
  misc_feature (632)..(632): n is a, c, g, or t/u
  misc_feature (636)..(636): n is a, c, g, or t/u
  misc_feature (638)..(638): n is a, c, g, or t/u
  misc_feature (683)..(683): n is a, c, g, or t/u
  misc_feature (695)..(695): n is a, c, g, or t/u
  misc_feature (703)..(703): n is a, c, g, or t/u
  misc_feature (710)..(710): n is a, c, g, or t/u
  misc_feature (716)..(716): n is a, c, g, or t/u
  misc_feature (723)..(724): n is a, c, g, or t/u
  misc_feature (729)..(729): n is a, c, g, or t/u
  misc_feature (778)..(778): n is a, c, g, or t/u
  misc_feature (795)..(795): n is a, c, g, or t/u
  misc_feature (820)..(821): n is a, c, g, or t/u
  misc_feature (824)..(824): n is a, c, g, or t/u
  misc_feature (830)..(830): n is a, c, g, or t/u
  misc_feature (868)..(869): n is a, c, g, or t/u
  misc_feature (875)..(875): n is a, c, g, or t/u
  misc_feature (879)..(879): n is a, c, g, or t/u
  misc_feature (885)..(885): n is a, c, g, or t/u
  misc_feature (893)..(895): n is a, c, g, or t/u
  misc_feature (901)..(901): n is a, c, g, or t/u
  misc_feature (907)..(907): n is a, c, g, or t/u
  misc_feature (918)..(918): n is a, c, g, or t/u
  misc_feature (920)..(920): n is a, c, g, or t/u
  misc_feature (934)..(934): n is a, c, g, or t/u
  misc_feature (937)..(937): n is a, c, g, or t/u
  misc_feature (940)..(940): n is a, c, g, or t/u
  misc_feature (942)..(942): n is a, c, g, or t/u
  misc_feature (951)..(951): n is a, c, g, or t/u
  misc_feature (957)..(957): n is a, c, g, or t/u
  misc_feature (960)..(960): n is a, c, g, or t/u
  misc_feature (970)..(970): n is a, c, g, or t/u
  misc_feature (977)..(977): n is a, c, g, or t/u
  misc_feature (988)..(988): n is a, c, g, or t/u
  misc_feature (992)..(992): n is a, c, g, or t/u
  misc_feature (1002)..(1002): n is a, c, g, or t/u
cggngggggaagcacaagctttattggctgaaagttcttctcaggagcctggtctgctgggactgcatgttcctggatgggctcccccaggcctaagctccaggtttcctctggccttccgaaggattttgtgggttacgaccaattgatcaaagatgactttttcctggcgcttgctcagctgcaaaagcttcatggtgttttgcaacttcttttcttgttcaaacaattttttatgtagtttggtgacctctgccttcatttctccaatctgctcacagtgaagggggcactggccatcctcggggagtgagactctccanagaagcttcagccgcctgtaggcctcttccagggtcagcttggccgtgctcacactgctcacaaacttgctcagtggtgctgggtgtggaccctttgttcccagctcttgacttgtggagctgggagcctcttgggtttgaatgtcatttcaacaaggagcctctgccctggctgatctgtttgagcagggcctcatagtcctcaatcangcccangacatggcggcattcttgctggcccacaggtggtggncantnccaggcgggacacacaccggagtgctaattggccgaactgccactgtccangaananggagtccgtgtcattcccaaaaaatggaggagctctgaaactgantttggggtcacnggctgggnggaatcnaaccgnatcaaanngaatntcctttccatgggaatatttggcacccatcctgtttgtcaaggctgaangggcaccctaagggatngacaccggtttgggaaaagccaaanngangggtcnttcttgggcctttttttggccccctttgccaaattttnnttgaancctntttcanaaaaggcnnngggttncaagcncccttttattngnaaggccaaaagccnganttncntaaggaggnttggcnggncctaaagganctgcccnttcaacttttnccanccctttaaantct

SEQ ID NO: 329 - DNA, 924 bp, Homo sapiens
  misc_feature (643)..(643): n is a, c, g, or t/u
  misc_feature (660)..(660): n is a, c, g, or t/u
  misc_feature (715)..(715): n is a, c, g, or t/u
  misc_feature (722)..(722): n is a, c, g, or t/u
  misc_feature (733)..(733): n is a, c, g, or t/u
  misc_feature (749)..(749): n is a, c, g, or t/u
  misc_feature (767)..(767): n is a, c, g, or t/u
  misc_feature (775)..(775): n is a, c, g, or t/u
  misc_feature (780)..(780): n is a, c, g, or t/u
  misc_feature (784)..(784): n is a, c, g, or t/u
  misc_feature (792)..(792): n is a, c, g, or t/u
  misc_feature (812)..(812): n is a, c, g, or t/u
  misc_feature (823)..(823): n is a, c, g, or t/u
  misc_feature (871)..(871): n is a, c, g, or t/u
  misc_feature (884)..(884): n is a, c, g, or t/u
  misc_feature (898)..(898): n is a, c, g, or t/u
  misc_feature (909)..(909): n is a, c, g, or t/u
  misc_feature (916)..(917): n is a, c, g, or t/u
gagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagccaagataatgagacagagaagacttcagttatggtgaacagtttttctcaagacttactaatggaacacatacaggaaattcgaactttgagaaacgtttagaagaatctattnaaacaaatgaaaagctncggaaaccagttggaacggcaaggatcttgaatttgttcaaggttctacaaacanttttggnttttggttcanagctttattagttctntaacattaaaaaaatcantttttggnggaanccanaaccaggnccctcaatggaatggcttanttaaagggatncccgagatttaacccggaagggggaatggcccaaatttcccagaggtncccttttccaagnaaaaacccgggaancctgggaacancctttanngggggaa

SEQ ID NO: 330 - DNA, 960 bp, Homo sapiens
  misc_feature (529)..(529): n is a, c, g, or t/u
  misc_feature (587)..(587): n is a, c, g, or t/u
  misc_feature (598)..(598): n is a, c, g, or t/u
  misc_feature (627)..(627): n is a, c, g, or t/u
  misc_feature (634)..(634): n is a, c, g, or t/u
  misc_feature (687)..(687): n is a, c, g, or t/u
  misc_feature (690)..(690): n is a, c, g, or t/u
  misc_feature (716)..(716): n is a, c, g, or t/u
  misc_feature (728)..(728): n is a, c, g, or t/u
  misc_feature (746)..(746): n is a, c, g, or t/u
  misc_feature (754)..(754): n is a, c, g, or t/u
  misc_feature (759)..(760): n is a, c, g, or t/u
  misc_feature (769)..(769): n is a, c, g, or t/u
  misc_feature (781)..(781): n is a, c, g, or t/u
  misc_feature (815)..(816): n is a, c, g, or t/u
  misc_feature (819)..(819): n is a, c, g, or t/u
  misc_feature (821)..(821): n is a, c, g, or t/u
  misc_feature (825)..(825): n is a, c, g, or t/u
  misc_feature (842)..(842): n is a, c, g, or t/u
  misc_feature (853)..(853): n is a, c, g, or t/u
  misc_feature (881)..(882): n is a, c, g, or t/u
  misc_feature (888)..(888): n is a, c, g, or t/u
  misc_feature (895)..(895): n is a, c, g, or t/u
  misc_feature (901)..(901): n is a, c, g, or t/u
  misc_feature (908)..(908): n is a, c, g, or t/u
  misc_feature (915)..(915): n is a, c, g, or t/u
  misc_feature (942)..(942): n is a, c, g, or t/u
gggggaagcacaagctttattggctgaaagttcttctcaggagcctggtctgctgggactgcatgttcctggatgggctcccccaggcctaagctccaggtttcctctggccttccgaaggattttgtgggttacgaccaattgatcaaagatgactttttcctggcgcttgctcagctgcaaaagcttcatggtgttttgcaacttcttttcttgttcaaacaattttttatgtagtttggtgacctctgccttcatttctccaatctgctcacagtgaagggggcactggccatcctcggggagtgagactctccagagaagcttcagccgctgtaggcctcttccagggtcagcttggccgtgctcacactgctcacaaacttgctcaatggtgctgggtgtggaccctttgttcccagctcttgacttgtggagctgggagcctcttgggtttgaatgtcatttcaacaaggagcctctgtccctggctgatctgtttgagcagggcctcatagtcctcaatcangcccaagacatggcggccattcttgctggcccacaaggtggtggccaatgaccaagcnggacacacacngagtgctagttgccgaactgccactgtcncaagaanagggaatccgtgtcatttccaaaaaagtggaggagtctctgaaactgaatttnggngtcactggcctgggaggaatcaaacngatcaaatgaantatccctttcatgggganatttgcancatcnngtttgtcangcttaaagggcncctaagggatggacaccggttgggaaaacccaanngangnctcnttcttggccttttttgnccccttgcaantgttcttgaacctgttttgaaaaggcgnnggttcnaaccccntttaantgcaacncaaaccngatttcattaagaggttgcaggccctnaaggaacttgccttcaac

SEQ ID NO: 331 - DNA, 666 bp, Homo sapiens
  misc_feature (610)..(610): n is a, c, g, or t/u
  misc_feature (636)..(636): n is a, c, g, or t/u
  misc_feature (647)..(647): n is a, c, g, or t/u
  misc_feature (666)..(666): n is a, c, g, or t/u
cggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatncatgacttgggaaactggaacttggnaaggctaccanaaatttcataatttcaacn

SEQ ID NO: 332 - DNA, 847 bp, Homo sapiens
  misc_feature (519)..(519): n is a, c, g, or t/u
  misc_feature (567)..(567): n is a, c, g, or t/u
  misc_feature (602)..(602): n is a, c, g, or t/u
  misc_feature (606)..(606): n is a, c, g, or t/u
  misc_feature (624)..(624): n is a, c, g, or t/u
  misc_feature (643)..(643): n is a, c, g, or t/u
  misc_feature (646)..(646): n is a, c, g, or t/u
  misc_feature (655)..(655): n is a, c, g, or t/u
  misc_feature (665)..(665): n is a, c, g, or t/u
  misc_feature (671)..(671): n is a, c, g, or t/u
  misc_feature (675)..(675): n is a, c, g, or t/u
  misc_feature (703)..(703): n is a, c, g, or t/u
  misc_feature (721)..(721): n is a, c, g, or t/u
  misc_feature (724)..(724): n is a, c, g, or t/u
  misc_feature (728)..(728): n is a, c, g, or t/u
  misc_feature (732)..(732): n is a, c, g, or t/u
  misc_feature (734)..(734): n is a, c, g, or t/u
  misc_feature (754)..(754): n is a, c, g, or t/u
  misc_feature (764)..(764): n is a, c, g, or t/u
  misc_feature (775)..(775): n is a, c, g, or t/u
  misc_feature (794)..(794): n is a, c, g, or t/u
  misc_feature (807)..(807): n is a, c, g, or t/u
  misc_feature (814)..(814): n is a, c, g, or t/u
  misc_feature (818)..(818): n is a, c, g, or t/u
  misc_feature (831)..(831): n is a, c, g, or t/u
gaaatgaaatgaatcatttaatgagaatcttcaaactgtggcactggctgagtactaagcaaatccaggggaagacgtgaagcccaccaaggcgcacagcctcaactccggtgcctgcccctgatctgaaatacaacatccaagagctcgaggcctttttaccacccgtttgtggagcacctgcacctttctgacaacaactctcaagccaactttcagagagaaaacatgaagggaaaaaatagatttcctttggccagacagctctttcttcctcaataaataggaaccacacttggaacaaagagacagcgtgagctcggtgggggaagcacaagctttattggctgaaagttcttctcaggagcctggtctgctgggactgcatgttcctggatgggctcccccaggcctaagctccaggtttcctctggccttccgaaggattttgtgggttacgaccaattgatcaaagatgactttttcctggcgcttgctcagctgcaaaagcttcatggngttttgcaacttcttttcttgttcaaacaattttttatgtagtttggngacctctgccttcatttctccaatctgctcacaangaanggggcactggccatcctnggggagtgagactctccanaanaagcttcancccgctgtanggcctntttncagggtcagttgggccggctcacactgnttacaaacttgcttaagnggngctngggngngggccctttggttccaactnttgactttgnggaactgggancccttttggggttgaatgnccattttaacaanggagccntttnccctggctgaatntgttgaacaggggcct

SEQ ID NO: 333 - DNA, 661 bp, Homo sapiens
  misc_feature (636)..(636): n is a, c, g, or t/u
gatgcctggatttttcaaaagcagattcaggtgttcatttatgtgttattgatgactccaatgagcatatgcttactgtatgggactggcagaggaaagcaaaaggagcagaaataaagacaacaaatgaagttgttttggctgtggagtttcacccaacagatgcaaataccataattacatgcggtaaatctcatattttcttctggacctggagcggcaattcactaacaagaaaacagggaatttttgggaaatatgaaaagccaaaatttgtgcagtgtttagcattcttggggaatggagatgttcttactggagactcaggtggagtcatgcttatatggagcaaaactactgtagagcccacacctgggaaaggacctaaaggtgtatatcaaatcagcaaacaaatcaaagctcatgatggcagtgtgttcacactttgtcagatgagaaatgggatgttattaactggaggagggaaagacagaaaaataattctgtgggatcatgatctgaatcctgaaagagaaatagagggtcctgatcagtatggcacaatcagagctgtagcagaaggaaagggcagatcaatttttagtaggccccatcaccgaaactttattttacganggaaccattttaatgatgggcttcc

SEQ ID NO: 334 - DNA, 798 bp, Homo sapiens
  misc_feature (577)..(577): n is a, c, g, or t/u
  misc_feature (580)..(580): n is a, c, g, or t/u
  misc_feature (583)..(583): n is a, c, g, or t/u
  misc_feature (593)..(593): n is a, c, g, or t/u
  misc_feature (605)..(605): n is a, c, g, or t/u
  misc_feature (621)..(622): n is a, c, g, or t/u
  misc_feature (646)..(646): n is a, c, g, or t/u
  misc_feature (666)..(666): n is a, c, g, or t/u
  misc_feature (673)..(673): n is a, c, g, or t/u
  misc_feature (707)..(707): n is a, c, g, or t/u
  misc_feature (709)..(709): n is a, c, g, or t/u
  misc_feature (774)..(774): n is a, c, g, or t/u
  misc_feature (779)..(779): n is a, c, g, or t/u
  misc_feature (789)..(789): n is a, c, g, or t/u
agaaagaggaaacattttgattattttattttttaatcttcaaaattttctgccatgagacaggaatgcatgatagcaatggctcaacatcttcacatgaaacacttggattcattttcattcacaagtttttctaaaaacatctacaatttcataaccccacccacttccaaccattatcacagatttaactgaccattaaacagtagttgccagcattaaatagctggaacgcttcctgcgtattagtagtgtcttttgaaactaccaccgaagagtatcatgattataaatctcattgtacatggcaaccccaaaggtgactgatgtcctcaaataaactccctgctgatcactgagagctgtattccccaggtacttaaagaaatgctctttcttctccaagaactgcctgttcatgtcagtatatttcttgcagggagtatagcacatgctgatctgatgatgtaataatcattgctaacagacagatatatatgcctgatacttactggcgcgctccgataagtatgtacagaacatacatactgaagaaagatggggtgcttggaatctnttnttnttttgaaaanaactattttganggtttttaacaggtgnnaaccaaagggaaggatttccgatnccttttccccataggagatntccctgngtatttttaacggggggcatatttttttatttananaaacccacaaggggttcccttggccctttaaacaaaccccaaacctttcatacaggggggggaantaaanggtggaaaanggccttggg

SEQ ID NO: 335 - DNA, 852 bp, Homo sapiens
  misc_feature (313)..(313): n is a, c, g, or t/u
  misc_feature (571)..(571): n is a, c, g, or t/u
  misc_feature (588)..(588): n is a, c, g, or t/u
  misc_feature (619)..(619): n is a, c, g, or t/u
  misc_feature (700)..(700): n is a, c, g, or t/u
  misc_feature (715)..(715): n is a, c, g, or t/u
  misc_feature (737)..(737): n is a, c, g, or t/u
  misc_feature (754)..(754): n is a, c, g, or t/u
  misc_feature (783)..(783): n is a, c, g, or t/u
  misc_feature (788)..(788): n is a, c, g, or t/u
  misc_feature (795)..(795): n is a, c, g, or t/u
  misc_feature (820)..(820): n is a, c, g, or t/u
  misc_feature (833)..(833): n is a, c, g, or t/u
  misc_feature (850)..(850): n is a, c, g, or t/u
ggatgttattaactggaggagggaaagacagaaaaataattctgtgggatcatgatctgaatcctgaaagagaaatagaggttcctgatcagtatggcacaatcagagctgtagcagaaggaaaggcagatcaatttttagtaggcacatcacgaaactttattttacgaggaacatttaatgatggcttccaaatagaagtacagggtcatacagatgagctttggggtcttgccacacatcccttcaaagatttgctcttgacatgtgctcaggacaggcaggtgtgcctgtggaactcaatggaacacangctggaatggaccaggctggtagatgaaccaggacactgtgcagattttcatccaagtggcacagtggtggccataggaacgcactcaggcaggtggtttgttctggatgcagaaaccagagatctagtttctatccacacagacgggaatgaacagctctctgtgatgcgctactcaatagatggtaccttcctggctgtaggatctcatgacaactttatttacctctatgtagtctctgaaaatggaagaaaatntagcagatatggaaggngcactggacattccagctacatcacacaccnttgacttggtccccaaacaacaagtatataatgtctaactcgggaaactattaaaatattgtctgggacattccaaatggnttgcaaactaatcanggaattcgatcgggtttgtaanggacattgattgggccnacattataccttgtgggcttaggatttcnaagtnttttggngtcttggccaaaaaggatcttgatngggacaaaatttnaatggcccttggggccnaa

SEQ ID NO: 336 - DNA, 791 bp, Homo sapiens
  misc_feature (609)..(609): n is a, c, g, or t/u
  misc_feature (625)..(625): n is a, c, g, or t/u
  misc_feature (627)..(627): n is a, c, g, or t/u
  misc_feature (629)..(629): n is a, c, g, or t/u
  misc_feature (640)..(640): n is a, c, g, or t/u
  misc_feature (660)..(660): n is a, c, g, or t/u
  misc_feature (672)..(672): n is a, c, g, or t/u
  misc_feature (714)..(714): n is a, c, g, or t/u
  misc_feature (749)..(749): n is a, c, g, or t/u
  misc_feature (753)..(753): n is a, c, g, or t/u
  misc_feature (760)..(760): n is a, c, g, or t/u
  misc_feature (769)..(769): n is a, c, g, or t/u
  misc_feature (776)..(776): n is a, c, g, or t/u
acattttgattattttattttttaatcttcaaaattttctgccatgagacaggaatgcatgatagcaatggctcaacatcttcacatgaaacacttggattcattttcattcacaagtttttctaaaaacatctacaatttcataaccccacccacttccaaccattatcacagatttaactgaccattaaacagtagttgccagcattaaatagctggaacgcttcctgcgtattagtagtgtcttttgaaactaccaccgaagagtatcatgattataaatctcattgtacatggcaaccccaaaggtgactgatgtcctcaaataaactccctgctgatcactgagagctgtattccccaggtacttaaagaaatgctctttcttctccaagaactgcctgttcatgtcagtatatgtcttgcagggagtatagcacatgctgatctgatgatgtaataatcattgctaacagacagatatatatgcctgatacttactggcgcgctccgataagtatgtcagaacatacatactgaagaaagatgggttgcttggaatctctcttcttttgaagagaactattttgagggtttttaacagttgtnaaccaaagggaagatntncngatcctattcncatagagatctcactgagtntttcaacgtggngcatatcttcttatctaaaaaaacacacagtgttttcacttngccctttaaacacacccacaccctttcattacagngggngaaaatnaatggtggnaaatgtnccttgggaagtcact

SEQ ID NO: 337 - DNA, 659 bp, Homo sapiens
  misc_feature (582)..(582): n is a, c, g, or t/u
  misc_feature (644)..(644): n is a, c, g, or t/u
tgtttttgcagcctctacaaccccacgtcagagtgtgggattctgttactctatccacactgcagattattggacttggcacttttgagcgtggagtaggatgcctggatttttcaaaagcagattcaggtgttcatttatgtgttattgatgactccaatgagcatatgcttactgtatgggactggcagaggaaagcaaaaggagcagaaataaagacaacaaatgaagttgttttggctgtggagtttcacccaacagatgcaaataccataattacatgcggtaaatctcatattttcttctggacctggagcggcaattcactaacaagaaaacagggaatttttgggaaatatgaaaagccaaaatttgtgcagtgtttagcattcttggggaatggagatgttcttactggagactcaggtggagtcatgcttatatggagcaaaactactgtagagcccacacctgggaaaggacctaaaggtgtatatcaaatcagcaaacaaatcaaagctcatgatggcagtgtgttcacactttgtcagatgagaaatgggatgttattaactggagganggaaagacagaaaaataattctgtgggatcatgatctgaatcctgaaagaagaaatagaggntcctggatcagtatg

SEQ ID NO: 338 - DNA, 829 bp, Homo sapiens
  misc_feature (557)..(557): n is a, c, g, or t/u
  misc_feature (584)..(584): n is a, c, g, or t/u
  misc_feature (598)..(598): n is a, c, g, or t/u
  misc_feature (633)..(633): n is a, c, g, or t/u
  misc_feature (639)..(639): n is a, c, g, or t/u
  misc_feature (644)..(644): n is a, c, g, or t/u
  misc_feature (652)..(652): n is a, c, g, or t/u
  misc_feature (680)..(680): n is a, c, g, or t/u
  misc_feature (723)..(723): n is a, c, g, or t/u
  misc_feature (737)..(737): n is a, c, g, or t/u
  misc_feature (740)..(740): n is a, c, g, or t/u
  misc_feature (745)..(746): n is a, c, g, or t/u
  misc_feature (762)..(762): n is a, c, g, or t/u
  misc_feature (766)..(766): n is a, c, g, or t/u
  misc_feature (773)..(773): n is a, c, g, or t/u
  misc_feature (785)..(785): n is a, c, g, or t/u
  misc_feature (812)..(812): n is a, c, g, or t/u
aacatttggattattttattttttaatcttcaaaattttctgccatgagacaggaatgcatgatagcaatggctcaacatcttcacatgaaacacttggattcattttcattcacaagtttttctaaaaacatctacaatttcataaccccacccacttccaaccattatcacagatttaactgaccattaaacagtagttgccagcattaaatagctggaacgcttcctgcgtattagtagtgtcttttgaaactaccaccgaagagtatcatgattataaatctcattgtacatggcaaccccaaaggtgactgatgtcctcaaataaactccctgctgatcactgagagctgtattccccaggtacttaaagaaatgctctttcttctccaagaactgcctgttcatgtcagtatatttcttgcagggagtatagcacatgctgatctgatgatgtaataatcattgctaacagacagatatatatgcctgatacttactggcgcgctccgataagtatgtacaagaacatacatactgaagaaagatgggttncttggaatctctcttcttttggaaganaactattttgaggntttttaacagtggtaaaccaaaaggaaaggatatncagatnccttntccacatngagatctacactgagtattttcaacggnggtgcatattttcttatctagagatacacacaggggtttccanttgcccctttacanacncccannaccttttcatacaagngggngaatttnaatgttgtaaangtccctgggaggttcactggagttttntttttcccaaatgagga

SEQ ID NO: 339 - DNA, 753 bp, Homo sapiens
  misc_feature (630)..(630): n is a, c, g, or t/u
  misc_feature (646)..(646): n is a, c, g, or t/u
  misc_feature (701)..(701): n is a, c, g, or t/u
  misc_feature (705)..(705): n is a, c, g, or t/u
  misc_feature (727)..(727): n is a, c, g, or t/u
  misc_feature (744)..(744): n is a, c, g, or t/u
gcctggctaggagcgccgaccgcagggcctctacggaccttactagaaaaatgaaacctgatgaaactcctatgtttgacccaagtctactcaaagaagtggactggagtcagaatacagctacattttctccagccatttccccaacacatcctggagaaggcttggttttgaggcctctttgtactgctgacttaaatagaggtttttttaaggtattgggtcagctaacagagactggagttgtcagccctgaacaatttatgaaatcttttgagcatatgaagaaatctggggattattatgttacagttgtagaagatgtgactctaggacagattgttgctacggcaactctgattatagaacataaattcatccattcctgtgctaagagaggaagagtagaagatgttgttgttagtgatgaatgcagaggaaagcagcttggcaaattgttattatcaacccttactttgctaagcaagaaactgaactgttacaagattacccttgaatgtctaccacaaaatgttggtttctataaaaagtttggatatactgtatctgaagaaaactacatgtgtcggaggtttctaaagtaaaaatcttgtaagaaaattgtcaaangggctaatgctacaangctacactcttttctaaagttgaaatatttttgttgcttgcagccgagtgacctncatnaatacctgggctgaaaaaacantggtaatactacaagtnttatggcca

SEQ ID NO: 340 - DNA, 879 bp, Homo sapiens
  misc_feature (252)..(252): n is a, c, g, or t/u
  misc_feature (267)..(267): n is a, c, g, or t/u
  misc_feature (645)..(645): n is a, c, g, or t/u
  misc_feature (656)..(656): n is a, c, g, or t/u
  misc_feature (675)..(675): n is a, c, g, or t/u
  misc_feature (681)..(681): n is a, c, g, or t/u
  misc_feature (768)..(768): n is a, c, g, or t/u
  misc_feature (780)..(780): n is a, c, g, or t/u
  misc_feature (795)..(795): n is a, c, g, or t/u
  misc_feature (798)..(798): n is a, c, g, or t/u
  misc_feature (822)..(822): n is a, c, g, or t/u
  misc_feature (832)..(832): n is a, c, g, or t/u
agaaccattaaaatatttaattcttcaactttaaaaaattaaataaaatcaaaataggataatgaccagaatagtgccattataatcacatcaaaaagcttccattaacattttatgaatttggcaatctagtacaatacattaagtattgtgtttcactcaattttgtgatactccatttttgaaaaaacttagaggcttcagatacccatgaaaagaaaaaaatcagggtagaaacacataggctgaggnttgctaattcactgnttacagaggaccttagatgtcccactataattgctcttaggtatttttaacaaatgaatagtcataattcacagaaaagacaagtggtctttttatctacatagactatactatataaactttcagtaaaacatttaaattgttttacttttaatcttgtcaagtaattttcatttcttctacttcaaaaggttgaccaggttgtttgcctgtattgggatcaacgaatgttggactatactatgtttagttataataactaatttatccaccctgacttaatatgtgggaaacaatacacccctaagtgtattgagatgtttctttgaaacaaaaatatttaattttatgcatgtgataaacagccttattcaatgntactttttttnaatgagccacccagatgcngacatntacttcctattacccatactcttgactcccaagaaagggagccaacttttagaaaaataccatgcaggaaaggatcaggttaaaatnttttccttggtnaaaaacatccccttntanattcattggaaactaaatcccgcnggtccccccncccaagaatctttaaaggcattttcctggggattccaaggttttccg

SEQ ID NO: 341 - DNA, 1551 bp, Homo sapiens
gggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactgcaattggtgctgaaaattcagaaaaaatagatgagaattcagataaagagatggaagtagaagaatcttcagagaaaataaaagtacagacaacaccaaaagtagaagaagaacaggatttgaaatttcagattggagaactggcaaataccctgccaagtaaattccgagtttctagcattaatagacaatccatcttcaactttcatgtgctgctcttccagactggaactcgaattgcaactggcgggaaagggctcttaatggaaactaccttaaacgaaaacttcaggatgcagcagaacaactaaaacagtatgaaataaacgccactcctaaaggctggtcctgccactgggacaggacctctggaagcaactactcctgattaacctcggtgaagttaaggaaaagttcgtggctgaagatgtgaatgaaagaactggcaaataccctgacaagtaaattcgagtttttaggcattaatagacaatccatctccaactttcatgtgctgctcttacagactgagactcgaattgcagactggcgggaaggggctcttaatggaaactaccttaaacgaaaacttcaggatgcagcagaacaactaaaacagtatgaaataaacgccactcctaaaggctggtcctgccactgggacaggacctctggaagcaactactcctgattaacctcggtgaagttaaggaaaacttcgtggctgaagatgtgaatgaagaacaagattactatcctctgccagcaggtcagatgaaaacatttctttatatatttggcttttcttgatttttttttcgttatttgaaatctttgctcttttatttttcagctcccagatcctctccctctctttagctttcactgtgtttgatatcaagaatatgaaatgtgaattccacggtccaagaggggaagagtcacctttcacaaacttcgttgttctcttctttggaagggaaattagtgttctaggcgattgagtcccttcattaatgaaacttgaaaccctgttatgcattggcaaatcac

SEQ ID NO: 342 - DNA, 932 bp, Homo sapiens
  misc_feature (602)..(603): n is a, c, g, or t/u
  misc_feature (691)..(691): n is a, c, g, or t/u
  misc_feature (747)..(747): n is a, c, g, or t/u
  misc_feature (758)..(758): n is a, c, g, or t/u
  misc_feature (766)..(766): n is a, c, g, or t/u
  misc_feature (798)..(798): n is a, c, g, or t/u
  misc_feature (807)..(807): n is a, c, g, or t/u
  misc_feature (824)..(824): n is a, c, g, or t/u
  misc_feature (855)..(855): n is a, c, g, or t/u
  misc_feature (904)..(904): n is a, c, g, or t/u
  misc_feature (912)..(913): n is a, c, g, or t/u
  misc_feature (916)..(916): n is a, c, g, or t/u
gggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactgcaattggtgctgaaaattcagaaaaaatagatgagaattcagataaagagatggaagtagaagaatcttcagagaaaataaaagtacagacaacaccaaaagtnnaagaagaacaggatttgaaatttcagattggagaactggcaaataccctgccaagtaaattccgagtttctagcattaatagacaatncatcttcaactttcatgtgctgctcttccagactggaactcgaattgcaactggcnggaaagggctntttatggnaactaccttaaccaaaactttagggtgccccngaacaactnaaccgtttgaaataacnccctcctaaagggtggtccttgccctggganaggacctttggaaccaactcctcctgattaacctcggggaaattaaggnaaaattcnnggntttaaaatgtgaattg

SEQ ID NO: 343 - DNA, 938 bp, Homo sapiens
  misc_feature (782)..(782): n is a, c, g, or t/u
  misc_feature (810)..(810): n is a, c, g, or t/u
  misc_feature (814)..(814): n is a, c, g, or t/u
  misc_feature (820)..(820): n is a, c, g, or t/u
  misc_feature (823)..(823): n is a, c, g, or t/u
  misc_feature (829)..(829): n is a, c, g, or t/u
  misc_feature (861)..(861): n is a, c, g, or t/u
  misc_feature (867)..(868): n is a, c, g, or t/u
  misc_feature (872)..(872): n is a, c, g, or t/u
  misc_feature (879)..(879): n is a, c, g, or t/u
  misc_feature (883)..(883): n is a, c, g, or t/u
  misc_feature (895)..(895): n is a, c, g, or t/u
  misc_feature (921)..(921): n is a, c, g, or t/u
  misc_feature (924)..(924): n is a, c, g, or t/u
  misc_feature (929)..(929): n is a, c, g, or t/u
gtgatttgccaatgcataacagggtttcaagtttcattaatgaagggactcaatcgcctagaacactaatttcccttccaaagaagagaacaacgaagtttgtgaaaggtgactcttcccctcttggaccgtggaattcacatttcatattcttgatatcaaacacagtgaaagctaaagagagggagaggatctgggagctgaaaaataaaagagcaaagatttcaaataacgaaaaaaaaatcaagaaaagccaaatatataaagaaatgttttcatctgacctgctggcagaggatagtaatcttgttcttcattcacatcttcagccacgaagttttccttaacttcaccgaggttaatcaggagtagttgcttccagaggtcctgtcccagtggcaggaccagcctttaggagtggcgtttatttcatactgttttagttgttctgctgcatcctgaagttttcgtttaaggtagtttccattaagagccccttcccgccagtctgcaattcgagtctcagtctgtaagagcagcacatgaaagttggagatggattgtctattaatgcctaaaaactcgaatttacttgtcagggtatttgccagttcttcaatctgaaatttcaaatcctggtcttcttctactttttgggggtgggctggcctttattttctctggaaaatcttctactttcatctctttatctgaatctcatctattttttctgaatttcaccaccaaatgcagttcttcattttctggagatctcgtccaanttactaaactccactgggaaaatctggntggnagcttnaanaaaatnttcatttttcttttttaacataaacctccccnttcctnntggnaagctgntggntggaattaaacngggctaaacctggaaaattcattttnttnttcanggttggaaa

SEQ ID NO: 344 - DNA, 797 bp, Homo sapiens
  misc_feature (600)..(600): n is a, c, g, or t/u
  misc_feature (719)..(719): n is a, c, g, or t/u
  misc_feature (722)..(722): n is a, c, g, or t/u
  misc_feature (735)..(735): n is a, c, g, or t/u
  misc_feature (749)..(749): n is a, c, g, or t/u
  misc_feature (759)..(759): n is a, c, g, or t/u
  misc_feature (777)..(777): n is a, c, g, or t/u
atgtaactaagttatctgtgaaggacaggttgggttttgtatcaaagccatctgtttcagcaactgaaaaggtgttgtctacatctactggcctaacaaaaacagtgtataatccagctgctttgaaggctgcacagaaaaccttacttgtttccacctctgcagttgataataatgaagcacagaaaaaaaaacaggaggcattgaaacttcagcaggatgtaaggaaaaggaaacaagaaattttagaaaagcacattgaaacacagaagatgttaatttcaaaactggagaaaaacaaaacaatgaagtctgaagataaagcagaaataatgaaaactttagaggttttgacaaaaaatattaccaagttgaaagatgaggtcaaagctgcttctcctggacgctgtcttccaaaaagtataaaaaccaagactcagatgcagaaggaattacttgacacagaactggatttatataagaagatgcaggctggagaagaagtcactgaacttaggagaaagtatacagaattacagctggaagctgccaaacgagggattctttcatctggtcggggcagaggaattcattcaagangtcgaggtgcagttcatggccgaagcagggggcgaaggccaaggccaagtgtgcctggcatgctgtggtggatcccgtccaaggcattggaaatttctgctttaccgggagcgataganaanatcttctttctcnttgcccaaattggngaaattgaanatggcaaaattggtgatnctcacttcatgccgaattac

SEQ ID NO: 345 - DNA, 737 bp, Homo sapiens
  misc_feature (434)..(434): n is a, c, g, or t/u
  misc_feature (495)..(495): n is a, c, g, or t/u
  misc_feature (501)..(501): n is a, c, g, or t/u
  misc_feature (529)..(529): n is a, c, g, or t/u
  misc_feature (584)..(584): n is a, c, g, or t/u
  misc_feature (612)..(612): n is a, c, g, or t/u
  misc_feature (628)..(628): n is a, c, g, or t/u
  misc_feature (651)..(651): n is a, c, g, or t/u
  misc_feature (654)..(654): n is a, c, g, or t/u
  misc_feature (661)..(661): n is a, c, g, or t/u
  misc_feature (677)..(677): n is a, c, g, or t/u
  misc_feature (683)..(683): n is a, c, g, or t/u
  misc_feature (697)..(697): n is a, c, g, or t/u
  misc_feature (707)..(707): n is a, c, g, or t/u
  misc_feature (717)..(717): n is a, c, g, or t/u
  misc_feature (723)..(723): n is a, c, g, or t/u
  misc_feature (725)..(725): n is a, c, g, or t/u
  misc_feature (735)..(735): n is a, c, g, or t/u
ggcattgcttttctcttttctttccttttttttttttaaagagaccattccactttattataacatctggatgcataaggactcatgtaaagcagtcatacaccattatcattaaaacccatatggtaaaatacatacacagtccaacaaaaggctaatacatagtaaagcctaagcatactactatgtaatattataatacataacttggagactttagttagagtactatgttatctattcagttttgaaaacattcattaagattttaaatgcaaattcattccttatttggaataaaacaaagtcctctaagttataacaagtattggtcataagttttcagacctattcattaaattacaaagaacccaaagaattctgtgatgtccagtagaagtatgtaataaaaacattgcatatgtttctagtgngatgtctttagcaattgtttactgaagtaaaatgcaaacatcaatctttcaaaatcaagancagaanggaggtttcttcttttttggctatttgngaaatccatcttcatccattttaccaaaaattgtttttacaaatatgtaaaagtncattagataatctaatgaaacacagggngaggtctagctatgcngatcaatgatcagtcaaatcatnttnttccaanaacgaaaatcattggnctcttntttttatcatcatnttgaaggaanggggcttccnccaaanancttttctggnaa

SEQ ID NO: 346 - DNA, 656 bp, Homo sapiens
caatacttcccttgtaatcgatgagactctcctggaacaggggcagctggataccccaggtgttcataatgtgacagccctgagcaacctcataacgtggcagaaggtggattatgacttcagctaccatcagatggaattcccctgcaatattaacgttttcattacttcggaggggaggtcactcctcccggcagactgccagattcacttacagccccagctaattccaccaaacatggaggagtacatgaacagccttctctcagcggtgctgccttccgtgctgaacaaattccgcatttatctaactcttttgagattcttggaatatagcatatctgatgaaataaccaaggcagttgaagatgactttgtggaaatgcggaagaacgaccctcagagcatcactgctgatgatcttcaccagctgctcgtggtggctcggtgtctgtctctcagtgctggtcagacaacgctgtcaagagaacgatggctgagagcaaagcagctagagtctttaagaagaacgaggcttcagcagcaaaaatgtgtgaatggaaatgaactttaaagatgtaatacctatgaagagtaatggggcaaactgtagccacataattgtaaaattcagatattcatttataccacattgg

SEQ ID NO: 347 - DNA, 914 bp, Homo sapiens
  misc_feature (613)..(613): n is a, c, g, or t/u
  misc_feature (632)..(632): n is a, c, g, or t/u
  misc_feature (677)..(677): n is a, c, g, or t/u
  misc_feature (693)..(693): n is a, c, g, or t/u
  misc_feature (699)..(699): n is a, c, g, or t/u
  misc_feature (725)..(725): n is a, c, g, or t/u
  misc_feature (739)..(739): n is a, c, g, or t/u
  misc_feature (744)..(744): n is a, c, g, or t/u
  misc_feature (749)..(749): n is a, c, g, or t/u
  misc_feature (753)..(753): n is a, c, g, or t/u
  misc_feature (759)..(759): n is a, c, g, or t/u
  misc_feature (783)..(783): n is a, c, g, or t/u
  misc_feature (799)..(799): n is a, c, g, or t/u
  misc_feature (804)..(804): n is a, c, g, or t/u
  misc_feature (874)..(874): n is a, c, g, or t/u
  misc_feature (905)..(905): n is a, c, g, or t/u
actgctaatttgggacgttttatttattggaaaggttctttcaagggaacttttctgcaagaccaagcaatgtatgtatttttctttggtaaattacaatttacattggcacaaaaaacacatggtgactaatgtactttgctctaggacaattaaagaaaatgtattttatcctcacaaatccagtgaagccttcattttatttctaaaagtttaaggaaggtctagtctaccagttataaaaatgaaaaccagttcaactctaatataaacattatttacatttgtttataaaaatagatttgagtttaggaaaagttgaacaactagttatttttacttcagttattaggtacaatgaattccttgatttttcaaggctgaccctgtttccttggttaacaatttcaatttaggccttataggaaaaaacgtaagggatcctttatctgcctccaactaggtaagttatttgataccactgacagcttaaaaagtaatgtcctaacctttctgaagattctggttgccataaccatgctactacagtctgttgttagtttgctctattaaaactaattggtctggagaaaacctacctgcagttgtcgangctggtactggagtaacanatgttagctgatctaacatactttggaaccactgatgatcccatnaaaaatgcccaaaatncaatanaatcaaagcacctcatgacatttaanaaaataaaactttntaaanggggnatgncttttnaagttcccattttgtttcatattngggcccagctttgtancccancattccctttgcatgggtctcaaatgccctgggattgggaaaaataaaaaacaagggggggcttggtttntttggcccccaaaacccatttatttccgttnaaggactcc

SEQ ID NO: 348 - DNA, 736 bp, Homo sapiens
  misc_feature (366)..(366): n is a, c, g, or t/u
  misc_feature (526)..(526): n is a, c, g, or t/u
  misc_feature (614)..(614): n is a, c, g, or t/u
  misc_feature (620)..(620): n is a, c, g, or t/u
  misc_feature (627)..(627): n is a, c, g, or t/u
  misc_feature (652)..(652): n is a, c, g, or t/u
  misc_feature (665)..(665): n is a, c, g, or t/u
  misc_feature (672)..(672): n is a, c, g, or t/u
  misc_feature (681)..(681): n is a, c, g, or t/u
  misc_feature (692)..(692): n is a, c, g, or t/u
cctgctcagagaaggcagcccctcacaaggctgagggcctggaggaggctgatactggggcctctgggtgccactcccatccggaagagcagccgaccagcatctcaccttccagacacggcgccctggctgagctctgcccgcctggaggctcccacaggatggccctggggactgctgctgcactcgggtcgaatgtcatcaggaatgagcagctgcccctgcagtacttggccgatgtggacacctctgatgaggaaagcatccgggctcacgtgatggcctcccaccattccaagcggagaggccgggcgtcttctgagagtcagggtctaggtgctggagtgcgcacggaggccgatgtanaggaggaggccctgaggaggaagctggaggagctgaccagcaacgtcagtgaccaggagacctcgtccgaggaggaggaagccaaggacgaaaaggcagagcccaacagggacaaatcagttgggcctctcccccaggcggacccggaggtgggcacggntgccatcaaaccaacagacaggaaaaaagcccccaggaccctggggaccccgtcagtcaacaggaccacagatgaggagctgtcaaanctggangacagantggcaattgaccggctttaaaagtncaacaggcaaaanaagcgangttttcaanacatttgaatncaaggattgcaaccccttaagggccccaagggcttcaaccggtg

SEQ ID NO: 349 - DNA, 774 bp, Homo sapiens
  misc_feature (600)..(600): n is a, c, g, or t/u
  misc_feature (650)..(650): n is a, c, g, or t/u
  misc_feature (714)..(714): n is a, c, g, or t/u
  misc_feature (747)..(747): n is a, c, g, or t/u
  misc_feature (753)..(753): n is a, c, g, or t/u
cagccttcctggcctccctggagcggggtaggcggatcattgatcggactctgaggaccctggggccttcagatatgttccctgctgaagtggcctggtccttgtcactgtgtggagacctgggactccccttggacatggtagagctgatgctggaggagaaaggggtccagctagactccgctggactggagcggttggcccaagaggaggcccagcaccgggcacggcaggctgagccagttcagaagcagggattgtggcttgatgtccatgcgcttggggagctgcagcgccaaggagtgcccccaactgacgacagccccaagtacaactactccctgcgacccagcggaagttatgagttcggcacctgtgaggcccaggtgttgcaactgtatacagaggacgggacagcagtggcctccgtggggaaaggccagcgctgtggcctcctcttggacaggaccaacttctacgcagaacaggggggccaggcttcagaccgtggctacctggtgcgggcagggcaagaggacgtgctgttcccagtagcccgggcccaggtctgtggaggtttcatcctgcatgaagcaatancccctgaatgcctgcggttaggggaccaggtgcaactgcatgtggatgangcctggcgtctaagctgcatggcgaaacatacgggcacccaccttgctgaactgggcacttgangcaaaaccctgggccctggcacaaaaacaacangggctnccattttaaatcctgaacaaa

SEQ ID NO: 350 - DNA, 872 bp, Homo sapiens
  misc_feature (193)..(193): n is a, c, g, or t/u
  misc_feature (593)..(593): n is a, c, g, or t/u
  misc_feature (634)..(634): n is a, c, g, or t/u
  misc_feature (638)..(638): n is a, c, g, or t/u
  misc_feature (674)..(674): n is a, c, g, or t/u
  misc_feature (677)..(677): n is a, c, g, or t/u
  misc_feature (740)..(740): n is a, c, g, or t/u
  misc_feature (777)..(777): n is a, c, g, or t/u
  misc_feature (805)..(805): n is a, c, g, or t/u
  misc_feature (809)..(809): n is a, c, g, or t/u
  misc_feature (837)..(837): n is a, c, g, or t/u
  misc_feature (850)..(850): n is a, c, g, or t/u
  misc_feature (859)..(859): n is a, c, g, or t/u
cctctgtgaaataatttatttatttgagacagagtctcgctctgtcacccaggctggagtgcagtggtgcgatcttggcccactgcaacctccacctcccaggttcaagcgattcttctgcctcagcctcccgagtagctgggactacaggtgtgtgccaccacacccggctaattttttgtatttttagtanagatggggtttcaccgtgttagccaggatggttttgatcttctgacctcatgatctacctgcctcggcctcccaaagtgcttggattacaggtgtgaaccaccacacccggccagtgaaataatttctaatgtgcagtcacagccataattgtccatgtcttctctttcaccaagggggtgtgtgtctttgggcccagttctgccttccctagcccatgtctccttgtgtcatgtaggccctggcccaggtgatcttctttggctcagctgcttggcctccagcctctagtcctcgcttcagcatgtgggaaggttctgctggctccttcagggctcctggcattgcctttagtccatgtggggtccctgggccggacctgggtcaaaagctggcttganggcataggtttggggctatactggagggcaagctttccaangtcnagtaagtgctttccggggccttgggcccaccacttnggngagccccacgcccttggccccccaatggggggcttggaacacttgccagtgccccaggccctntggttgtgaaaagggggggcaatgggcacccttgggncaccttggaaagggcacaacaagaaccntttncccattgggccttggggggcttgaattnggaaaccccaaancgttgcttngggggccctggtt

SEQ ID NO: 351 - DNA, 709 bp, Homo sapiens
  misc_feature (636)..(636): n is a, c, g, or t/u
  misc_feature (654)..(654): n is a, c, g, or t/u
  misc_feature (674)..(674): n is a, c, g, or t/u
  misc_feature (696)..(696): n is a, c, g, or t/u
  misc_feature (698)..(698): n is a, c, g, or t/u
cagccttggattgtaattcagaagaaaataacttcttgacgcgggaaaatggcgagcccgacgcatttgatgagctctttgatgccgacggcgacggtgaatcttatacagaagaggctgatgatggagaaacaggagagacaagagacgaaaaggaaaatctggccactctctttggagatatggaggacttaacagatgaagaagaagttcccgcatcacagtcaactgaaaatagggtcctccctgctcctgcccccaggcgagagaaaacgaatgaagagttgcaagaggaattaaggaatttgcaagagcaaatgaaggccttacaagagcagctaaaagtaacaacaattaaacagacagcaagcccagcccgtctgcaaaaatcccctgtagagaagtctccccggccacctcttaaggagaggagagttcagagaattcaggagtcaacatgcttttctgcggagcttgatgtccctgcgctaccaagaaccaagagggtggctcgaacaccaaaggcttcacctccagatcccaaaagctcatcttcaaggatgacaagtgcaccctcccaacccctacagacgatttctcggaacaaacctagtgggatactagaggtcaaattgngggggacccccaggaagntcttggggaaacgactcaancccatctgtgtggaaacctttntntggtcttgggg

SEQ ID NO: 352 - DNA, 772 bp, Homo sapiens
  misc_feature (552)..(552): n is a, c, g, or t/u
  misc_feature (586)..(586): n is a, c, g, or t/u
  misc_feature (607)..(607): n is a, c, g, or t/u
  misc_feature (627)..(627): n is a, c, g, or t/u
  misc_feature (633)..(633): n is a, c, g, or t/u
  misc_feature (650)..(650): n is a, c, g, or t/u
  misc_feature (672)..(672): n is a, c, g, or t/u
  misc_feature (674)..(674): n is a, c, g, or t/u
  misc_feature (702)..(702): n is a, c, g, or t/u
  misc_feature (724)..(724): n is a, c, g, or t/u
  misc_feature (729)..(729): n is a, c, g, or t/u
  misc_feature (739)..(741): n is a, c, g, or t/u
gaatgaagaaatctggcttttaatgtccgtacatcaagactatgtgatcatcattatctagatgggaaagttttattatttgtagaaatccagtgctaaaaaatacatttcaggatcacttagtccaatcttcctgattttacagatgagaaaactgaagcccagaagttaagctacttacctggagtgagaattaagccaaattcttttgcctctgggtgttcgtataaacactagaattttgttatgataaagaagtgaacactctataaccaaaagatacagaaacatagctctctgtttaccttccaatttttgggcaaaaacttcagtgaatgaagtaatgcaatcatccacactgagcttagaaaagacaatgataacttggttttccacttaaatgtcaatgttaaatgtggtatcaaaccaacccaatggcagaaagtaagcaggcaaagcttatgggcttaacaagcatttgtttttgacggcgtcaatcaggaatcaatggacaatacacagccaatcctttgctttccagagtcacaggangccaggaagtctgtgggaaaatgtctgaagttcnggttatttaaaggctggtcanaaatttaacatggtcttctncctttngggaaccagaatttctncctcctatcttttggaccaagncnttttccttttacatttccgtccccgttncccattttggtaggaagggccnccagnttcctggcannngctttggtttccggggagtttttggtcccaa

SEQ ID NO: 353 - DNA, 1102 bp, Homo sapiens
  misc_feature (17)..(17): n is a, c, g, or t/u
  misc_feature (43)..(43): n is a, c, g, or t/u
  misc_feature (932)..(932): n is a, c, g, or t/u
  misc_feature (938)..(938): n is a, c, g, or t/u
  misc_feature (954)..(954): n is a, c, g, or t/u
  misc_feature (1020)..(1020): n is a, c, g, or t/u
  misc_feature (1031)..(1031): n is a, c, g, or t/u
  misc_feature (1055)..(1055): n is a, c, g, or t/u
  misc_feature (1067)..(1067): n is a, c, g, or t/u
  misc_feature (1077)..(1077): n is a, c, g, or t/u
  misc_feature (1093)..(1093): n is a, c, g, or t/u
tcggcgcctgcaggtgngactctagtggatccaaagattcggncaaggcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgccacagggcggntacganatccccgcgcgggtgnggacgctccacaacctggtgatccagtacccctcgcaagggcgcctacaaggtagctgtgcccctnttcaagcaggncctggagggcctggagaaaacttnaggacaccaacnccccgacgtnggcccccttgctcaanattcttggg

SEQ ID NO: 354 - DNA, 603 bp, Homo sapiens
  misc_feature (17)..(17): n is a, c, g, or t/u
  misc_feature (43)..(43): n is a, c, g, or t/u
  misc_feature (123)..(123): n is a, c, g, or t/u
  misc_feature (232)..(232): n is a, c, g, or t/u
  misc_feature (241)..(242): n is a, c, g, or t/u
  misc_feature (245)..(245): n is a, c, g, or t/u
  misc_feature (469)..(469): n is a, c, g, or t/u
  misc_feature (475)..(475): n is a, c, g, or t/u
  misc_feature (478)..(478): n is a, c, g, or t/u
  misc_feature (545)..(545): n is a, c, g, or t/u
  misc_feature (561)..(561): n is a, c, g, or t/u
  misc_feature (567)..(567): n is a, c, g, or t/u
  misc_feature (571)..(571): n is a, c, g, or t/u
  misc_feature (588)..(588): n is a, c, g, or t/u
tcggcgcctgcaggtgngactctagtggatccaaagattcggncaaggcggcgcaggcggccgagcgggactggctgggtcggctgggctgctggtgcgaggagccgcggggctgtgctcggnggccaaggggacagcgcgtgggtggccgaggatgctgcggggcggtagctccggcgcccctagctggtgactgctgcgccgtgcctcacacagccgaggcgggctcggngcacagtcnntgntccgcgcgcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattacattttacaaagtttgctgganacactnaantgtttgaagaaagatgatgaaagtaattttggtggaggagaaatcaaacatgatcggaagtcactgnagatgtttggagctcncctgantgangcacaagttatgatggntttttcaaattacct

SEQ ID NO: 355 - DNA, 708 bp, Homo sapiens
  misc_feature (588)..(588): n is a, c, g, or t/u
  misc_feature (597)..(597): n is a, c, g, or t/u
  misc_feature (622)..(622): n is a, c, g, or t/u
  misc_feature (630)..(630): n is a, c, g, or t/u
  misc_feature (635)..(635): n is a, c, g, or t/u
  misc_feature (643)..(643): n is a, c, g, or t/u
  misc_feature (645)..(645): n is a, c, g, or t/u
  misc_feature (687)..(687): n is a, c, g, or t/u
  misc_feature (693)..(693): n is a, c, g, or t/u
  misc_feature (698)..(698): n is a, c, g, or t/u
aaggcatataaacttttaatttaaaaaaatgtacaataaaatacgttatcgcacacaacgtgaggaagttacacatgggaagggagccgtgggcccagctcatgccccaggtctcctgggagagaccacgccgcaccagggcaccagcttaggcccagccccagccccaaggtcacgccagccgtgtggttattagtatcatgtcctatgcacacagacgcaggagaaatgagtgagcgctgcggctcccggccaggggccctccctgccgccctggctgtcccgggccagctccgggccacactcggcagtcccatcctggagcggggccaggtcggggtcaagttagcggtggcgtcttccaggccactgctgctgctgtcgttttccacaaaaagaggctcggccagagacgccccggggttctttggctcactctctcgtgaacttcctcccttcacttcctaaccagctttcactgctgcgtctaatggaagcccggagtttgctaaaggaaccactgcgttttaaagatccagtgccatcttcctcccctccgtcagggccactttcgtacttgaccacgtncacgttgangctctcacgggttctgcgctttttncattgttnttaangggcattngncactttctgccacccttttggtttgtgaaacaattgtcaaanaacctnttttnccgaaaaact

SEQ ID NO: 356 - DNA, 608 bp, Homo sapiens
  misc_feature (501)..(501): n is a, c, g, or t/u
  misc_feature (594)..(594): n is a, c, g, or t/u
cgtgcctcacacagcccgaggcgggctcggcgcacagtcgctgctccgcgcgcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcaaaaactgcgtgcgcaggttcgtcgtctgtgccaggagaatcaatggctaccggatgaactggcccacacgcacanaaactgcagaaaaatgacaatctgtggcttaactggaggaggagaaaaaacatcttgagtttattaatcaacttaaaaaattgatgaccgacntttcccattcgagg

SEQ ID NO: 357 - DNA, 715 bp, Homo sapiens
  misc_feature (87)..(87): n is a, c, g, or t/u
  misc_feature (95)..(95): n is a, c, g, or t/u
  misc_feature (184)..(184): n is a, c, g, or t/u
  misc_feature (614)..(614): n is a, c, g, or t/u
  misc_feature (627)..(627): n is a, c, g, or t/u
  misc_feature (673)..(673): n is a, c, g, or t/u
ctttttgagacagagtcttgggggggaaaaagtgtactttgaaaagaaaatcaaaagttggtcgagtttagcattctgccttctcanaaccttanagttgtggggttggaggccaaggccttcctctgaagactctgaggcagcctcagctgcccacccagtgaattcactcattttatctaanactccatctgaagagggggctgcctccatgcacaaagtgagtctaggaaccactgcactggataatttaaaactcaaactgttttggtagatcacccgtggccaacgcaccctgggatgaattccatcaaacctgcagagctatcaggggacacaccagatacacagcctgcacatggcctatagaatcaggtgtccaaagtgagaaaggaagcgtggaaggaggaaaccagcaggcgtgcagaggagcagctgctttcatccccagcagcgacacttccagcccgcgggcctgacggggacacctgcccacgaaccccctgcaggggacacgagttctccttcctctccgagtccatctttaaaatggtaacagagctctgaatcgtcccattttatcatcagatgatttcatgtcaacatggacctanaaatactgtcttnaagaaaaaactttcttccaaacttcattcaaaaaggatcacaattntgcaccctggcttcctacaagccttaaataaaaggactttgt

SEQ ID NO: 358 - DNA, 628 bp, Homo sapiens
gcgcaggcggccgagcgggactggctgggtcggctgggctgctggtgcgaggagccgcggggctgtgctcggcggccaaggggacagcgcgtgggtggccgaggatgctgcggggcggtagctccggcgcccctcgctggtgactgctgcgccgtgcctcacacagccgaggcgggctcggcgcacagtcgctgctccgcgctcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaaacaaaaactgcgtgcgcaggttcgtccgtctgtgccaggagaatcaatggctac

SEQ ID NO: 359 - DNA, 690 bp, Homo sapiens
  misc_feature (520)..(520): n is a, c, g, or t/u
  misc_feature (526)..(526): n is a, c, g, or t/u
  misc_feature (542)..(542): n is a, c, g, or t/u
  misc_feature (608)..(608): n is a, c, g, or t/u
  misc_feature (619)..(619): n is a, c, g, or t/u
  misc_feature (643)..(643): n is a, c, g, or t/u
  misc_feature (655)..(655): n is a, c, g, or t/u
  misc_feature (665)..(665): n is a, c, g, or t/u
  misc_feature (681)..(681): n is a, c, g, or t/u
caggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgccacagggcggntacganatccccgcgcgggtgnggacgctccacaacctggtgatccagtacccctcgcaagggcgcctacaaggtagctgtgcccctnttcaagcaggncctggagggcctggagaaaacttnaggacaccaacnccccgacgtnggcccccttgctcaanattcttggg

SEQ ID NO: 360 - DNA, 675 bp, Homo sapiens
  misc_feature (541)..(541): n is a, c, g, or t/u
  misc_feature (592)..(592): n is a, c, g, or t/u
  misc_feature (595)..(595): n is a, c, g, or t/u
  misc_feature (646)..(646): n is a, c, g, or t/u
  misc_feature (654)..(654): n is a, c, g, or t/u
attttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatcccggaagtcactggagatgttggagctcggcctgagtgangcacaagttatgatggctttgtcaaatcacctgaatgctgtggagtccaanaancaaaaactgcgttgcgcaagttcgtcgtcttgtgcccaggaaaaaatcaantggttacnggatgaaactgggccaacccc

SEQ ID NO: 361 - DNA, 2581 bp, Homo sapiens
  misc_feature (518)..(518): n is a, c, g, or t/u
  misc_feature (539)..(539): n is a, c, g, or t/u
  misc_feature (2408)..(2408): n is a, c, g, or t/u
atctcccagaagagaaactgggaaagaaagcaggaagtctcaatcaccatctcctaagaatgagtcagccagaggccggaaaaaatcccgttctcagtccccaaaaaaggatattgcaagagaaaggaggcaatctcagtctcggtctccaaaaagggatactactagggaaagcagaagatctgaatcactgtccccaagaagagaaacttctagagagaacaaaagatctcagccaagagtgaaagattcttccccaggagaaaaatccaggtcccagagcagagaacgagaaagtgatagagatgggcagaggagagagagagaaaggagaaccagaaagtggtctaggtccagatctcattctaggtccccctcaagatgtagaacaaaaagtaagagttcatcatttggtagaattgacagagatagttactctccccggtggaagggaagatgggcaaatgatggttggagatgtccaccaggaaatgatcggtacagaaagaatgacccanagaaaccgaatgaaaatacangaaaagaaaaaaatgacatccatctagatgctgatgatccaaattctgctgacaaacatagaaatgactgtcccaattggataacagaaaaaataaactctgggcctgatccaagaaccagaaatccagaaaagttgaaagagtctcattgggaagaaaatagaaatgaaaattcaggaaattcttggaataaaaactttggttctggttgggtatctaaccgtggtagaggcagaggcaaccgtggcagaggcacttacagaagtagttttgcctataaagatcagaatgaaaatcggtggcaaaatcgaaaacccctctcagggaattcaaacagttcagggagtgaatctttcaagtttgtggaacagcaatcctataagcgaaaaagtgaacaggagttctcatttgatacaccagcagatagatctggatggacatctgcatccagctgggccgtgagaaagactttgccagcagatgtacaaaactactactcacgacgaggcagaaattcttcaggtccacagtctggatggatgaaacaagaggaggaaacatctggacaggattctagcctaaaagaccaaacaaaccagcaagttgatggttctcagctacctataaatatgatgcaaccgcaaatgaatgtaatgcagcaacaaatgaatgcacaacaccagcctatgaatatcttcccatatccagtgggtgttcatgctcctttgatgaacatccaacgcaatccatttaacattcatcctcagctacccttgcatctccacacaggagtgcccctcatgcaggtagccactcctaccagtgtatctcagggactaccaccaccaccaccccctcccccaccatcccaacaagtcaactacattgcttcacaaccagatggaaagcaattgcagggtattcctagttcttctcatgtaagtaataacatgagtacaccagttttgcctgctccgacagcagccccaggaaatacgggaatggttcagggaccaagttctggtaatacttcgtcatcaagtcacagcaaagcctctaatgctgctgtaaaattggcagaaagcaaagtaagtgttgcagtggaagccagcgcagatagctcgaagacagacaagaaattgcaaattcaagaaaaagcagcacaagaggtaaaattggccatcaagccattttaccaaaataaagatatcaccaaggaagaatataaagaaattgtacggaaagcagtagataaagtttgtcatagtaagagtggagaagtaaattctactaaagtggcaaatctggttaaagcctatgtagacaaatacaaatattcacggaaggggagccaaaagaaaactctggaagaacctgtgtctactgaaaaaaacataggctgaaatggggaacgctgtcaaggacattatcaggatatctgcaaagtgcaatttcaacatgtaccattaactgaaaatcatacataactgtgattgaaatttggtttgataaaattatttttttaacataggatatgatgttttgttctaaataaatataggtctgcactgcaacttctgtatccttccttcccctccaccctcccccacaaaattcaagggaaagtaaagggtttaaaggaatgtgcatctttactaggactgtgttatagtgtggatactggaaaatgtatagctttttgattagggcaatggagtgcataaattagaaacttctaagtgcactggttttcaaagagatatatataatgcatttattctgtcaggttaaaatataaagtatgatctttatgattttttccctctaattatagaaagttaaataatgtattaccatgaaaaatgtttntaatattaaatagaacatatcagttgcaaagttcctaatgtgtatttttaaagcacatatctgaataaattgcctagatagaaaaaaaattatcacgagtaaaatttagtgttcaaaacattgagacactcttcacctattgtatgaccaaataaaggttatgctgcttgttt

SEQ ID NO: 362 - DNA, 664 bp, Homo sapiens
  misc_feature (556)..(556): n is a, c, g, or t/u
  misc_feature (572)..(572): n is a, c, g, or t/u
  misc_feature (582)..(582): n is a, c, g, or t/u
  misc_feature (584)..(584): n is a, c, g, or t/u
  misc_feature (641)..(641): n is a, c, g, or t/u
aagaaccagaaatccagaaaagttgaaagagtctcattgggaagaaaatagaaatgaaaattcaggaaattcttggaataaaaactttggttctggttgggtatctaaccgtggtagaggcagaggcaaccgtggcagaggcacttacagaagtagttttgcctataaagatcagaatgaaaatcggtggcaaaatcgaaaacccctctcagggaattcaaacagttcagggagtgaatctttcaagtttgtggaacagcaatcctataagcgaaaaagtgaacaggagttctcatttgatacaccagcagatagatctggatggacatctgcatccagctgggccgtgagaaagactttgccagcagatgtacaaaactactactcacgacgaggcagaaattcttcaggtccacagtctggatggatgaaacaagaggaggaaacatctggcaggattctagcctaaaagaccaaacaaaccacaagttgatggtctcaactcctataatatgatgcaaccccaaatgaatgtaatgcagcacaaatgaatgcncacccacctataatanttccatttcnangggtgtctctctttgtgacatccaccccatcattttacattcttcttactaccttgnttttccccaagagtgccctcttc

SEQ ID NO: 363 - DNA, 735 bp, Homo sapiens
  misc_feature (174)..(174): n is a, c, g, or t/u
  misc_feature (581)..(581): n is a, c, g, or t/u
  misc_feature (622)..(622): n is a, c, g, or t/u
  misc_feature (649)..(649): n is a, c, g, or t/u
  misc_feature (668)..(668): n is a, c, g, or t/u
  misc_feature (684)..(684): n is a, c, g, or t/u
aaacaagcagcataacctttatttggtcatacaataggtgaagagtgtctcaatgttttgaacactaaattttactcgtgataattttttttctatctaggcaatttattcagatatgtgctttaaaaatacacattaggaactttgcaactgatatgttctatttaatattanaaacatttttcatggtaatacattatttaactttctataattagagggaaaaaatcataaagatcatactttatattttaacctgacagaataaatgcattatatatatctctttgaaaaccagtgcacttagaagtttctaatttatgcactccattgccctaatcaaaaagctatacattttccagtatccacactataacacagtcctagtaaagatgcacattcctttaaaccctttactttcccttgaattttgtgggggagggtggaggggaaggaaggatacagaagttgcagtgcagacctatatttatttagaacaaaacatcatatcctatgttaaaaaaataattttatcaaaaccaaatttcaatcacaggtatgtatgattttcagttaatggnacatgttgaaattgcactttggcagatatcccggataatgnccttgacaggcgttccccatttcaagnctatggttttttcaagtanaccaaggtctttccanaggtttcttttggctcccctttccgggaaaatttgggatttgggctacata

SEQ ID NO: 364 - DNA, 698 bp, Homo sapiens
  misc_feature (531)..(531): n is a, c, g, or t/u
  misc_feature (543)..(543): n is a, c, g, or t/u
  misc_feature (574)..(574): n is a, c, g, or t/u
  misc_feature (584)..(584): n is a, c, g, or t/u
  misc_feature (614)..(614): n is a, c, g, or t/u
  misc_feature (623)..(623): n is a, c, g, or t/u
  misc_feature (653)..(653): n is a, c, g, or t/u
  misc_feature (686)..(686): n is a, c, g, or t/u
gtcacagcaaagcctctaatgctgctgtaaaattggcagaaagcaaagtaagtgttgcagtggaagccagcgcagatagctcgaagacagacaagaaattgcaaattcaagaaaaagcagcacaagaggtaaaattggccatcaagccattttaccaaaataaagatatcaccaaggaagaatataaagaaattgtacggaaagcagtagataaagtttgtcatagtaagagtggagaagtaaattctactaaagtggcaaatctggttaaagcctatgtagacaaatacaaatattcacggaaggggagccaaaagaaaactctggaagaacctgtgtctactgaaaaaaacataggctgaaatggggaacgctgtcaaggacattatcaggatatctgcaaagtgcaatttcaacatgtaccattaactgaaaatcatacataactgtgattgaaatttggtttgataaaattatttttttaacataggatatgatgttttgttctaaataaatataagtctgcactgnaacttctgtatnctttcttccctcaccctccccacaaattcanggaaagtaanggtttaaaggatgtcatctttctagactgngtatagtgnggatactgggaaatgtttactttttgttanggcatggagtgcataattaaaacttctaatgcnctggtttcaaga

SEQ ID NO: 365 - DNA, 688 bp, Homo sapiens
  misc_feature (679)..(679): n is a, c, g, or t/u
agtttatcaaaagaatttattagaaaatattacacactacatacatatttatttaagagtataatttcagtagacagcactccaacttcataatacaaacaatatctcatggaccctggggcaatcactgtgcttctgaagctacatcttttggatggaacattccagcagtacacactgtggccatttaaaggaaggtaagagaaaaaaatgtgataattaccaaaacaaattttaaaaagcacaaaacttttggaatgttaatggataactactattagtctcaaaattctaggcatttctataaaacattggtcaatgtgactagtaagttaacgggaccaaggtttcaaagatcaatactgaaccttgataaataataagaggaaatgtaactccacaaaatgtttctgattaagtttgtgcccatgcaaaattaacataaatttcttaactcaagaatgaggaatattaaagcaatgtattttttcaacataaagcatgcattttctaatacattcttaaacatttcaaaattttaaaagttcgaattctaatcaagtagctattaatgcagtctaaccagtgccccaaatcagacatggaacacacacttgttactgtcacggaaataattcatgggagtgctactaaaaatatatgagactttaacttttgnccccatcac

SEQ ID NO: 366 - DNA, 663 bp, Homo sapiens
  misc_feature (518)..(518): n is a, c, g, or t/u
  misc_feature (539)..(539): n is a, c, g, or t/u
  misc_feature (647)..(647): n is a, c, g, or t/u
atctcccagaagagaaactgggaaagaaagcaggaagtctcaatcaccatctcctaagaatgagtcagccagaggccggaaaaaatcccgttctcagtccccaaaaaaggatattgcaagagaaaggaggcaatctcagtctcggtctccaaaaagggatactactagggaaagcagaagatctgaatcactgtccccaagaagagaaacttctagagagaacaaaagatctcagccaagagtgaaagattcttccccaggagaaaaatccaggtcccagagcagagaacgagaaagtgatagagatgggcagaggagagagagagaaaggagaaccagaaagtggtctaggtccagatctcattctaggtccccctcaagatgtagaacaaaaagtaagagttcatcatttggtagaattgacagagatagttactctccccggtggaagggaagatgggcaaatgatggttggagatgtccaccaggaaatgatcggtacagaaagaatgacccanagaaaccgaatgaaaatacangaaaagaaaaaaatgacatccatctagatgctgatgatcccaattcttgtggcaaacattgaaatgactgtcccattggattacagaaaaaataaactcttggcctgncccagaaccagaaatt

SEQ ID NO: 367 - DNA, 770 bp, Homo sapiens
  misc_feature (688)..(688): n is a, c, g, or t/u
  misc_feature (695)..(695): n is a, c, g, or t/u
aaaatgacatccatctagatgctgatgatccaaattctgctgacaaacatagaaatgactgtcccaattggataacagaaaaaataaactctgggcctgatccaagaaccagaaatccagaaaagttgaaagagtctcattgggaagaaaatagaaatgaaaattcaggaaattcttggaataaaaactttggttctggttgggtatctaaccgtggtagaggcagaggcaaccgtggcagaggcacttacagaagtagttttgcctataaagatcagaatgaaaatcggtggcaaaatcgaaaacccctctcagggaattcaaacagttcagggagtgaatctttcaagtttgtggaacagcaatcctataagcgaaaaagtgaacaggagttctcatttgatacaccagcagatagatctggatggacatctgcatccagctgggccgtgagaaagactttgccagcagatgtacaaaactactactcacgacgaggcagaaattcttcaggtccacagtctggatggatgaaacaagaggaggaaacatctggacaggattctagcctaaaagaccaaacaaaccagcaagttgatggttctcagctacctataaatatgatgcaacccgcaaatgaatgtaatgcagcacaaatgaatgcccacaccagcctatgaatatcttnccatatncagtgggtgttcatgctccttttgatgaacattccaccccaatccatttaacattcattcctcagcttcccttgc

SEQ ID NO: 368 - DNA, 800 bp, Homo sapiens
  misc_feature (696)..(696): n is a, c, g, or t/u
  misc_feature (711)..(711): n is a, c, g, or t/u
  misc_feature (749)..(749): n is a, c, g, or t/u
  misc_feature (759)..(759): n is a, c, g, or t/u
  misc_feature (780)..(780): n is a, c, g, or t/u
  misc_feature (797)..(797): n is a, c, g, or t/u
aaacatctggacaggattctagcctaaaagaccaaacaaaccagcaagttgatggttctcagctacctataaatatgatgcaaccgcaaatgaatgtaatgcagcaacaaatgaatgcacaacaccagcctatgaatatcttcccatatccagtgggtgttcatgctcctttgatgaacatccaacgcaatccatttaacattcatcctcagctacccttgcatctccacacaggagtgcccctcatgcaggtagccactcctaccagtgtatctcagggactaccaccaccaccaccccctcccccaccatcccaacaagtcaactacattgcttcacaaccagatggaaagcaattgcagggtattcctagttcttctcatgtaagtaataacatgagtacaccagttttgcctgctccgacagcagccccaggaaatacgggaatggttcagggaccaagttctggtaatacttcgtcatcaagtcacagcaaagcctctaatgctgctgtaaaattggcagaaagcaaagtaagtgttgcagtggaagccagcgcagatagctcgaagacagacaagaaattgcaaattcaagaaaaagcagcacaagaggtaaaattggccatcaagccattttaccaaaataaagatatcaccaaggaagaatataaagaaattgtccggaaagcagtanataaagttggcatantaagagtggagaagtaaattcttactaagtggcaaaantggttaaagnctatgtagacaaatacaaatnttcacggaagggagccnaaa

SEQ ID NO: 369 - DNA, 1336 bp, Homo sapiens
  misc_feature (1161)..(1161): n is a, c, g, or t/u
  misc_feature (1196)..(1196): n is a, c, g, or t/u
  misc_feature (1202)..(1202): n is a, c, g, or t/u
  misc_feature (1204)..(1204): n is a, c, g, or t/u
  misc_feature (1227)..(1227): n is a, c, g, or t/u
  misc_feature (1258)..(1258): n is a, c, g, or t/u
  misc_feature (1263)..(1263): n is a, c, g, or t/u
  misc_feature (1284)..(1284): n is a, c, g, or t/u
gtttccagggaaggcagcgagcaggatcccctactctgcgggcggcgcgaggcgtctggctcttcgcggcggcggcgaggggaaagggagcgcgggggctgggtggaatcgaggagtgaggaaaaagggaaggggcgggggagagggaccagggaaggcgtcggggggaatctcgcgagggttggagttttggcgagagtttgtggaagatggcgcctgttgtgacaggtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcngaccgcattatttggatgcagatgaacctgtgtcncaactncnttaaatgtgcattttacccttanggatccagaaagaatggttttgtgccttttntcaanaaagaataattcaattttcangccccctccttgttccaaaggaaccccaattaagggggatggattaatggat

SEQ ID NO: 370 - DNA, 815 bp, Homo sapiens
  misc_feature (640)..(640): n is a, c, g, or t/u
  misc_feature (675)..(675): n is a, c, g, or t/u
  misc_feature (681)..(681): n is a, c, g, or t/u
  misc_feature (683)..(683): n is a, c, g, or t/u
  misc_feature (706)..(706): n is a, c, g, or t/u
  misc_feature (737)..(737): n is a, c, g, or t/u
  misc_feature (742)..(742): n is a, c, g, or t/u
  misc_feature (763)..(763): n is a, c, g, or t/u
cagaagtcatatggaaatgaaaaaaggtttttttgcccacctccttgtgtatatcttatgggcagtggatggaagaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcngaccgcattatttggatgcagatgaacctgtgtcncaactncnttaaatgtgcattttacccttanggatccagaaagaatggttttgtgccttttntcaanaaagaataattcaattttcangccccctccttgttccaaaggaaccccaattaagggggatggattaatggat

SEQ ID NO: 371 - DNA, 625 bp, Homo sapiens
  misc_feature (435)..(435): n is a, c, g, or t/u
  misc_feature (449)..(449): n is a, c, g, or t/u
  misc_feature (480)..(480): n is a, c, g, or t/u
  misc_feature (524)..(524): n is a, c, g, or t/u
  misc_feature (536)..(536): n is a, c, g, or t/u
  misc_feature (540)..(540): n is a, c, g, or t/u
  misc_feature (542)..(542): n is a, c, g, or t/u
  misc_feature (548)..(548): n is a, c, g, or t/u
  misc_feature (551)..(551): n is a, c, g, or t/u
  misc_feature (556)..(556): n is a, c, g, or t/u
  misc_feature (614)..(614): n is a, c, g, or t/u
ggaagatggcgcctgttgtgacaggtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaanaagtctcaacccgngtgcatttattgggataggaaataagtgccnaaaaatgcaccacttaacttggaaggaaagaactattgcacagnccaaacatttgntatntntgactnaanacaanccgaaagcacttctgttgtctgtaaaaaatgttctttggcacaaggatgacatttggngggttcctcaa

SEQ ID NO: 372 - DNA, 741 bp, Homo sapiens
  misc_feature (209)..(209): n is a, c, g, or t/u
  misc_feature (245)..(245): n is a, c, g, or t/u
  misc_feature (353)..(353): n is a, c, g, or t/u
  misc_feature (528)..(528): n is a, c, g, or t/u
  misc_feature (531)..(531): n is a, c, g, or t/u
  misc_feature (548)..(548): n is a, c, g, or t/u
  misc_feature (588)..(588): n is a, c, g, or t/u
  misc_feature (612)..(612): n is a, c, g, or t/u
  misc_feature (626)..(626): n is a, c, g, or t/u
  misc_feature (628)..(628): n is a, c, g, or t/u
  misc_feature (631)..(631): n is a, c, g, or t/u
  misc_feature (689)..(689): n is a, c, g, or t/u
  misc_feature (698)..(698): n is a, c, g, or t/u
  misc_feature (725)..(725): n is a, c, g, or t/u
  misc_feature (730)..(730): n is a, c, g, or t/u
gtttccagggaaggcagcgagcaggatcccctactctgcgggcggcgcgaggcgtctggctcttcgcggcggcggcgaggggaaagggagcgcgggggctgggtggaatcgaggagtgaggaaaaagggaaggggcgggggagagggaccagggaaggcgtcggggggaatctcgcgagggttggagttttggcgagagtttgtggaanatggcgcctgttgtgacaggtcattgaaattatganactatcattcaaatggaagcattatagttcttcggaaccattatgatctcaaaacgaaaggagaatgatacagatacactggctgaggtgttttgaggtgcatcaaantgttccaagctgtgacttaccttaacatgttcttgaagtaccatggcgtggattaaaaggaaatttggtgatcggcctccacctaaacgacttactagggaagctatgcgaaattatttaaaagagcgaggggatcaaaccgtacttattcttcatgcaaaagttgcacagaaantcntatggaaatgaaaaaangttttttttcccacctccttgtgtatatctttatgggcanccggatggaaagaaaaaaaaaaanaacaaatgggaacncnatngtttttcttgaacaaagaatctcaaaccgtgttgccatttattgggataggaaaatanttaccaaanaaatgccaacaacttaaccttggaaangaaanaaactttttgc

SEQ ID NO: 373 - DNA, 752 bp, Homo sapiens
  misc_feature (455)..(455): n is a, c, g, or t/u
  misc_feature (557)..(557): n is a, c, g, or t/u
  misc_feature (603)..(603): n is a, c, g, or t/u
  misc_feature (639)..(639): n is a, c, g, or t/u
  misc_feature (645)..(645): n is a, c, g, or t/u
  misc_feature (676)..(676): n is a, c, g, or t/u
  misc_feature (678)..(678): n is a, c, g, or t/u
  misc_feature (685)..(685): n is a, c, g, or t/u
actgtggcttctgcatttcaaatcagcacttgcagggagacaacggggtttttgaatagtatcacctggtatgaaaagttttcccaagaaaccacaaacgattgttcattttttctccttttttgttaactttttgccacactcaagtcagtttaagtcctagcaaaaagacggtagttaggataccactgtggctgtagatgatgtgacactggttgaatttgtgctggcgtttgtgtaacttccctcgctgtttgtgtttgattcgttagggggcacctggcttgaattggctcgaaggattgctcctgctgcactgcaatgtggccgcggccctggttctggtgtgtaggtaaaggtaaggctggtggaataaatgattccatcatttcggaccaaagttactggaacctggactggttgccggacccatctccaaccttctcggaatgcanaaatgtctgggacgacacagagcatactctctccacacctgtacatagtttcagcttctacatccccaaaccacactcgtaaatttggagtgaaattctgtnctgtaagttcaagcattgctacgtccccaccgccattcaactgaangctctctaccacaggcacaggagtgactggggcaanggacanggcccattccctcataaaatgtatactctgncntatctgngctaatgattggcccagaagccccatcatttatcatccctttatttgggtcttttgggacatgggag

SEQ ID NO: 374 - DNA, 768 bp, Homo sapiens
  misc_feature (739)..(739): n is a, c, g, or t/u
  misc_feature (747)..(747): n is a, c, g, or t/u
aaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtcccgagatggctacatccattatggacaaacagtcaaacttgtgtgctcagttactggcatggcctccccaagattgataattaaggaaagttgataagcaagacccgcattattggatgcagatgatcctgtgtcacaaactcattaaatgtgccattttaccntaaggatncagaaaagaatggtttttgtg

SEQ ID NO: 375 - DNA, 665 bp, Homo sapiens
  misc_feature (386)..(386): n is a, c, g, or t/u
  misc_feature (602)..(602): n is a, c, g, or t/u
  misc_feature (604)..(604): n is a, c, g, or t/u
  misc_feature (653)..(653): n is a, c, g, or t/u
tgtggaagatggcgcctgttgtgacaggtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagnggatggaagaaaaaaaagaacaaatggaacgcgatggttgttctgaacaagagtctcaaccgtgtgcatttattgggataggaaatagtgaccaagaaatgcagcagctaaacttggaaggaaagaactattgcacaccaaaacattgtatatatcttgactcaacaagccgaaaagccccttcatgttgtctgtaaagatgttctatggcaacangngatgacattgggggggttcctcacaaagccggattaaaaagtcattttncaaaccctttcc

SEQ ID NO: 376 - DNA, 698 bp, Homo sapiens
  misc_feature (542)..(542): n is a, c, g, or t/u
  misc_feature (647)..(647): n is a, c, g, or t/u
  misc_feature (666)..(666): n is a, c, g, or t/u
gcgtggttcaggcgggtgtcttcggccgggcttgggaacataaaagtttgtttcaccacgtaagccggacctcgcactccggtcccggtctcgtcgccaagatggtgaagcccaagtacaaaggacggagcaccatcaacccgtccaaggccagcacaaacccagatcgagtgcagggagcaggaggccaaaacatgagggaccgggccaccatccggcgcctgaatatgtataggcaaaaggagcgcaggaacagtcgtggtaaaataattaaacccctgcaatatcaatcaacggtggcttctggcacagtggcaagagtagagccaaatattaaatggtttggaaacacacgtgtgattaagcagtcatcattacaaaaatttcaagaggaaatggatacagttatgaaggatccatacaaagttgtcatgaagcaaagcaagttaccaatgtctcttcttcatgatcgaatccggcctcataacttgaaggggcacattcttgatactgaaagttttgaaactacatttggccctaantcacagaaggaaaccgaccaaacttattttgcaagtgatatgcagtctcttatcgaaaatgcttgaaatgtccactgagaacttttgaccaagggcaaggatcgngatttggtaactggaaganactggggtgagaaatggaagcttcaagaaaaa

SEQ ID NO: 377 - DNA, 797 bp, Homo sapiens
  misc_feature (10)..(10): n is a, c, g, or t/u
  misc_feature (693)..(693): n is a, c, g, or t/u
  misc_feature (701)..(701): n is a, c, g, or t/u
  misc_feature (714)..(714): n is a, c, g, or t/u
  misc_feature (724)..(724): n is a, c, g, or t/u
  misc_feature (748)..(748): n is a, c, g, or t/u
ggcgggtgtnttcggccgggcttgggaacataaaagtttgtttcaccacgtaagccggacctcgcactccggtcccggtctcgtcgccaagatggtgaagcccaagtacaaaggacggagcaccatcaacccgtccaaggccagcacaaacccagatcgagtgcagggagcaggaggccaaaacatgagggaccgggccaccatccggcgcctgaatatgtataggcaaaaggagcgcaggaacagtcgtggtaaaataattaaacccctgcaatatcaatcaacggtggcttctggcacagtggcaagagtagagccaaatattaaatggtttggaaacacacgtgtgattaagcagtcatcattacaaaaatttcaagaggaaatggatacagttatgaaggatccatacaaagttgtcatgaagcaaagcaagttaccaatgtctcttctccatgatcgaatccggcctcataacttgaaggtgcacattcttgatactgaaagttttgaaactacatttggccctaagtcacagaggaaacgaccaaacttatttgcaagtgatatgcagtctcttatcgaaaatgctgaaatgtccactgagagctatgacccagggcaaggatcgtgatttggtaactgaaagacactggtgtgagaaatgaagctcaagaagagatctattaaaangggcagtnccaaaagaatatngggtgagctnttacaaggggatagatttattcanatgttgtagttcaagttctttgatgcttgaaaaaccaatggggtactcg

SEQ ID NO: 378 - DNA, 776 bp, Homo sapiens
  misc_feature (2)..(2): n is a, c, g, or t/u
  misc_feature (278)..(278): n is a, c, g, or t/u
  misc_feature (583)..(583): n is a, c, g, or t/u
  misc_feature (588)..(588): n is a, c, g, or t/u
  misc_feature (618)..(618): n is a, c, g, or t/u
  misc_feature (620)..(620): n is a, c, g, or t/u
  misc_feature (643)..(643): n is a, c, g, or t/u
  misc_feature (668)..(668): n is a, c, g, or t/u
  misc_feature (687)..(687): n is a, c, g, or t/u
  misc_feature (691)..(691): n is a, c, g, or t/u
  misc_feature (703)..(703): n is a, c, g, or t/u
  misc_feature (737)..(737): n is a, c, g, or t/u
  misc_feature (748)..(748): n is a, c, g, or t/u
gnttttgtataatttaataaaaaccttttaaacattactgcttttgtctgaattttttgcgtttgtgtttctgtccctctgagtcattggtcttctttttgttcctgttcctatttttcacgttgtgtgtttcatagtagcgcacaccaacttttttcggccgttgctgtcgtactgctcgcctccgttcttttgatgtaagcgccctgggagctttatttgaatgttcctgttcctcttccctttgtgccttccgcttctttccctttttggaaggngctctgtcatctacatcttcttccagtgtttttctttgttcttcaggttttgcaaatatcttttcactcagtcccttggatattctgactgctgaaaactttttggctttggctttgtctagaaacttctgatatttgacaatcttctcatccagtgctttaataacggctttggtgtcgtttcccacattttcctcctcaggctccgaggaagactcttcccgcatcatctctttggtgctcctgttcctcctcctcttcattaaaaaaaagctctcaagctctttctcaagatctgacacctncacangaaccaggtcattcccaaaaaactgaggcncncgttgaattttaccaaagtctgncgactcgtggaagaatctgccgcanctctggggtaaccttacanggancgggccccttcngtcttccttaaaggaagggatctggacccttcanctgcaggtttntgggacttcctcccctggaatgggtctt

SEQ ID NO: 379 - DNA, 633 bp, Homo sapiens
  misc_feature (585)..(585): n is a, c, g, or t/u
cctgggcaacaaaacggtgggttgctgtcctctcccaggattatccaacacttgctttccatgcaagccttactaacccgtttggcaagggagcattcattcagcttctgcggcagtttggaaagttgcacactgacaagaaacagatcagtgttgggttcattggctatccaaatgttggcaagagctctgtgataaatacattgcgttctaagaaagtttgcaacgtggctcccattgcaggtgaaacaaaggtctggcagtatattactttgatgcgtcggatattcctgattgactgtccaggtgtggtttacccctctgaggactccgagacagacattgtgctaaaaggagttgttcaagtagaaaaaattaagagtcctgaagaccacattggtgctgtacttgaacgagcaaagccagaatatatcagcaaaacatacaagattgattcttgggagaatgctgaggactttcttgagaagctcgctttccggactgggaagttactaaagggtggagagcccgacttgcagactgtgggtaagatggtcctcaatgactggcaaaagggccggattnctttctttgtcaagccacccaatgcagagcccttgtgggcccccactt

SEQ ID NO: 380 - DNA, 630 bp, Homo sapiens
  misc_feature (544)..(544): n is a, c, g, or t/u
gttcaggcgggtgtcttcggccgggcttgggaacataaaagtttgtttcaccacgtaagccggacctcgcactccggtcccggtctcgtcgccaagatggtgaagcccaagtacaaaggacggagcaccatcaacccgtccaaggccagcacaaatccagatcgagtgcagggagcaggaggccaaaacatgagggaccgggccaccatccggcgcctgaatatgtataggcaaaaggagcgcaggaacagtcgtggtaaaataattaaacccctgcaatatcaatcaacggtggcttctggcacagtggcaagagtagagccaaatattaaatggtttggaaacacacgtgtgattaagcagtcatcattacaaaaatttcaagaggaaatggatacagttatgaaggatccatacaaagttgtcatgaagcaaagcaagttaccaatgtctcttctccatgatcgaatccggcctcataacttgaaggtgcacattcttgatactgaaagttttgaaactacatttggccctaagtccagangaaacgaccaaacttatttgcaagtgatatgcagtctcttatcgaaaatgctgaaatgtccactgagagctatgacaagggcaagg

SEQ ID NO: 381 - DNA, 1285 bp, Homo sapiens
  misc_feature (1184)..(1184): n is a, c, g, or t/u
ctgaaattgatcaagttgttcctgcagcacagtcttcacctataaactgtgagaagagagaaaacttgttaccatttgtgggactgaataatctcggcaatacttgctatcttaatagtatacttcaggtattatatttttgtcccggttttaaatctggagtaaagcacttatttaatattatttcaaggaagaaagaagctctaaaggatgaagccaatcaaaaagacaagggaaattgcaaagaagattctttggcaagttatgaattgatatgcagtttacagtccttaatcatttcggttgaacagctccaggctagttttctcttaaatccagagaaatatactgatgaacttgccactcagccaaggcgactgcttaacacactgagggaactcaaccctatgtatgaaggatatctacagcatgatgcacaggaagtattacaatgtattttgggaaacattcaagaaacatgccaactcctaaaaaaagaagaagtaaaaaatgtggcagaattacctactaaggtagaagaaatacctcatccgaaagaggaaatgaatggtattaacagcatagagatggacagtatgaggcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaagaaaatgaatgtgatcctgaagaggacttggggaagtgtgaaagtgataacacaactaatggttgtggacttgaatctccaggaaatactgttacacctgtaaatgttaatgaagttaaacccataaacaaaggtgaagaacaaattggtttttgagcctagtggagaaattatttcaagggtcagcttggtattaaaggcgccgttgctttggaatgtgaaagtttaacnggaaaggaagagaagattttcaagacatcagtgtgccagtacaaaaaagatgaacttttccaagtaaaagaaagttcttgaaatttttccgaacccaaaac

SEQ ID NO: 382 - DNA, 658 bp, Homo sapiens
  misc_feature (534)..(534): n is a, c, g, or t/u
  misc_feature (580)..(580): n is a, c, g, or t/u
  misc_feature (588)..(588): n is a, c, g, or t/u
  misc_feature (596)..(596): n is a, c, g, or t/u
  misc_feature (603)..(603): n is a, c, g, or t/u
ctgaaattgatcaagttgttcctgcagcacagtcttcacctataaactgtgagaagagagaaaacttgttaccatttgtgggactgaataatctcggcaatacttgctatcttaatagtatacttcaggtattatatttttgtcccggttttaaatctggagtaaagcacttatttaatattatttcaaggaagaaagaagctctaaaggatgaagccaatcaaaaagacaagggaaattgcaaagaagattctttggcaagttatgaattgatatgcagtttacagtccttaatcatttcggttgaacagctccaggctagttttctcttaaatccagagaaatatactgatgaacttgccactcagccaaggcgactgcttaacacactgagggaactcaaccctatgtatgaaggatatctacagcatgatgcacaggaagtattacaatgtattttgggaaacattcaagaaacatgccaactcctaaaaaaagaagaagtaaaaaatgtggcagaattcctactaaggnagaagaaatcctcatccgaagaagaaatgaatggtttacagcatanagatggcnagatgagncttctgnagacttttaagagaactcccaaaggaatggggaaagaaaaagtgccctggatttg

SEQ ID NO: 383 - DNA, 721 bp, Homo sapiens
  misc_feature (610)..(610): n is a, c, g, or t/u
  misc_feature (625)..(625): n is a, c, g, or t/u
  misc_feature (646)..(646): n is a, c, g, or t/u
  misc_feature (655)..(655): n is a, c, g, or t/u
  misc_feature (657)..(657): n is a, c, g, or t/u
  misc_feature (666)..(666): n is a, c, g, or t/u
  misc_feature (704)..(704): n is a, c, g, or t/u
agttaagcagtttaaattttattgacctcccagtttttaaaaaaagttaaatttaaggtcacacctctaagtttgatgtactatatacagatcgtgcagaatatgagttaaacagatacaaattagtccatgcccaaaaagatatactagggtacagaatcatcttcataaatacatataaaattcttgtgtagaagcgaactgtccaggttttctgagacacttctaagtgaatcaaggcacaaaatgtacatacaccattgtgaatacacacattctagactttgtgcctctgacatagcccaaggatttagcttcatgactcttataaaactaaatgtactgaatgagattctgcttcttgggtgaaaaaccacaggaactataaacatcatgtagataattactccaaaatatggagaatacaaatacgagcactttattttaaaaagcaaacacaaaagactggtgtaaatccaagtgtttaaatgcctccgttttggataatttaattaagaaccgatcaagtttgttcccagaagctaatgcatcactagtctctactgaggaaaatgagttctaaaaattaacatgggtttcagtaattcanatttcactatttatnttaaaaacctagaggggaccnattattttncngtagcttcnaaagataaactaaagattctttgatgtaatcacttttnccaatggttgggatggg

SEQ ID NO: 384 - DNA, 812 bp, Homo sapiens
  misc_feature (711)..(711): n is a, c, g, or t/u
gaaacatgccaactcctaaaaaaagaagaagtaaaaaatgtggcagaattacctactaaggtagaagaaatacctcatccgaaagaggaaatgaatggtattaacagcatagagatggacagtatgaggcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaagaaaatgaatgtgatcctgaagaggacttggggaagtgtgaaagtgataacacaactaatggttgtggacttgaatctccaggaaatactgttacacctgtaaatgttaatgaagttaaacccataaacaaaggtgaagaacaaattggtttttgagcctagtggagaaattatttcaagggtcagcttggtattaaaggcgccgttgctttggaatgtgaaagtttaacnggaaaggaagagaagattttcaagacatcagtgtgccagtacaaaaaagatgaacttttccaagtaaaagaaagttcttgaaatttttccgaacccaaaac

SEQ ID NO: 385 - DNA, 676 bp, Homo sapiens
cattttgaaatttaataattctaatagtaacaagaaacatagtttatgcttttttttaaatgaaaacaaacaagtaattttgtaaaagtcagaaaacaccagtatccttctgatctcatcctggatttttctgtcagctggaggatgcatttctgaccccatcccagacacgtgaaagcagaagacatgatgcatctataataatgaaagcacaatctaaagagtattatcacaccgtgaacagcttcttcctgacccagagcaaatattaagagaaagacaatatatttacaaacaagatttaataatgctcacaagaatagagtttgcccccaaatggaaaattacacattattttgtttcaaaaagttataaatttagtgcttgaaaaatccagcaggtaagtagaaggactaacagggtctgtttctggaactgtccgccagcaaatgagcatgctctgtcctggaagccatttttctttttctttctttttttttttctttgagacagagtttttttgctcgttgcccaggctggagtacaaaggtgcaatctcggctcaccacaacctccgccccttgggttcaagcaattctcctgcctcagcctcctgagcagctgggattacaggcatgtgccaccacgcctggctaacttttctgtattttcagta

SEQ ID NO: 386 - DNA, 714 bp, Homo sapiens
  misc_feature (628)..(628): n is a, c, g, or t/u
  misc_feature (635)..(635): n is a, c, g, or t/u
aaaatgtggcagaattacctactaaggtagaagaaatacctcatccgaaagaggaaatgaatggtattaacagcatagagatggacagtatgaggcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaagaaaatgaatgtgatcctgaagaggacttggggaagtgtgaaagtgataacacaactaatggttgtggacttgaatctccaggaaatactgttacacctgtaaatgttaatgaaagttaaacccataaaccaaggtgaagaacaaattgggttttgagctagtggagaaattatttcaaggnccagctngtattaaggccccttgctttggaatggggaaaggtttacccgaaaggaagaagaagattttccaggacattcggtggtg

SEQ ID NO: 387 - DNA, 1109 bp, Homo sapiens
  misc_feature (937)..(937): n is a, c, g, or t/u
  misc_feature (980)..(980): n is a, c, g, or t/u
  misc_feature (988)..(988): n is a, c, g, or t/u
  misc_feature (1005)..(1005): n is a, c, g, or t/u
  misc_feature (1027)..(1027): n is a, c, g, or t/u
  misc_feature (1069)..(1069): n is a, c, g, or t/u
  misc_feature (1080)..(1080): n is a, c, g, or t/u
  misc_feature (1084)..(1084): n is a, c, g, or t/u
ataccaactgaggtggctatagagtccacaccaatgatactggaatctagtatcatgtcatcacatgttatgaaaggaattaatctatcctctggtgatcaaaatcttgctccagagattggcatacaggagattgcattgcattcaggtgaagaaccacatgctgaggaacacctgaaaggtgacttttacgaaagtgaacatggtataaatatagaccttaatataaataatcatttaattgctaaagagatggaacataatacagtgtgtgctgctggtactagtcctgttggggaaattggtgaagagaaaattttgcccaccagtgagactaaacagtgcacagtattggatacctaccctggtgttagtgaagctgatgcaggagaaactctatcttctactggtccttttgctctggaacctgatgcaacaggaactagtaagggtattgaatttaccacagcatctactctcagtttagttaataaatatgatgttgatttatctttaactactcaagatactgaacatgacatggtaatttccaccagtcctagtggtggtagtgaagctgacattgaagggcctttgcctgctaaagatattcatcttgatttaccatctaataataaccttgttagtaaggatacagaagaaccattacctgtaaaagagagtgaccagacattagcagctctgctcagccctaaagaaagtagtggaggagaaaaagaagtacctccccctcctaaagagacactgcctgattcaggattttctgccaatattgaggatattaatgaagcagatttagtgagaccgttacttcctaaggacatggaacgtcttacaagccttaaaagctggcatttgaaggacctttacttgcaagtgatgtttggaccgtggacaagatctgctggccagcccngtttgtaagtagtatgcccagaaagaactttcagaggtctttntttcaganggaaaaaggattgattnttgaaaattttttgttaaaagnttaaagggcccctccccgaaaaaaaagccaggaaaaattaangaacccggggntaangggggggggaaaggaggaaagaaaa

SEQ ID NO: 388 - DNA, 823 bp, Homo sapiens
  misc_feature (651)..(651): n is a, c, g, or t/u
  misc_feature (694)..(694): n is a, c, g, or t/u
  misc_feature (702)..(702): n is a, c, g, or t/u
  misc_feature (719)..(719): n is a, c, g, or t/u
  misc_feature (741)..(741): n is a, c, g, or t/u
  misc_feature (783)..(783): n is a, c, g, or t/u
  misc_feature (794)..(794): n is a, c, g, or t/u
  misc_feature (798)..(798): n is a, c, g, or t/u
gtcctgttggggaaattggtgaagagaaaattttgcccaccagtgagactaaacagtgcacagtattggatacctaccctggtgttagtgaagctgatgcaggagaaactctatcttctactggtccttttgctctggaacctgatgcaacaggaactagtaagggtattgaatttaccacagcatctactctcagtttagttaataaatatgatgttgatttatctttaactactcaagatactgaacatgacatggtaatttccaccagtcctagtggtggtagtgaagctgacattgaagggcctttgcctgctaaagatattcatcttgatttaccatctaataataaccttgttagtaaggatacagaagaaccattacctgtaaaagagagtgaccagacattagcagctctgctcagccctaaagaaagtagtggaggagaaaaagaagtacctccccctcctaaagagacactgcctgattcaggattttctgccaatattgaggatattaatgaagcagatttagtgagaccgttacttcctaaggacatggaacgtcttacaagccttaaaagctggcatttgaaggacctttacttgcaagtgatgtttggaccgtggacaagatctgctggccagcccngtttgtaagtagtatgcccagaaagaactttcagaggtctttntttcaganggaaaaaggattgattnttgaaaattttttgttaaaagnttaaagggcccctccccgaaaaaaaagccaggaaaaattaangaacccggggntaangggggggggaaaggaggaaagaaaa

SEQ ID NO: 389 - DNA, 679 bp, Homo sapiens
  misc_feature (220)..(220): n is a, c, g, or t/u
  misc_feature (441)..(441): n is a, c, g, or t/u
  misc_feature (531)..(531): n is a, c, g, or t/u
  misc_feature (578)..(578): n is a, c, g, or t/u
  misc_feature (582)..(582): n is a, c, g, or t/u
  misc_feature (614)..(614): n is a, c, g, or t/u
  misc_feature (641)..(641): n is a, c, g, or t/u
attccagagaagtttgtatttgggccttaagcttttgaaaataaagtttagagacatagcatatgaataccactgtaatacacatgaaatattctatcagaccctaaaaattaacataaacttttaactttctcatagtcaacaaaatagtggctggttgccaattttattagataagttggttacagcattttaattatcattttacgtctatctaggngtagctgaaattcaaaatgcacatcaaagtaaaactatatcacaactcaatgccatactaaatgtacttggcctctgcaatagaattctagtcagacttcattttttactcccttcttatgacccaagtggctttaacaggaatgcaggacttagtgctgatcatcacacaacataccactttctttttagaacctctacaaaattttgaggggagatggnggcattagccctgtggaacagatcttgatcacctcaataacactggcccattatctgtccagcagaacccattgtgaaatagtacaaggngcacagccttcactgattacaggcaagtggttacagtagcctaaccntaanggaaggggaggtccatcttagtacaaaaatcnagtttaaaagcggtttttaacattccncactggaaaatacctttggtgcctttaaacagtcgttt

SEQ ID NO: 390 - DNA, 664 bp, Homo sapiens
  misc_feature (565)..(565): n is a, c, g, or t/u
  misc_feature (584)..(584): n is a, c, g, or t/u
  misc_feature (593)..(593): n is a, c, g, or t/u
  misc_feature (608)..(608): n is a, c, g, or t/u
ataccaactgaggtggctatagagtccacaccaatgatactggaatctagtatcatgtcatcacatgttatgaaaggaattaatctatcctctggtgatcaaaatcttgctccagagattggcatacaggagattgcattgcattcaggtgaagaaccacatgctgaggaacacctgaaaggtgacttttacgaaagtgaacatggtataaatatagaccttaatataaataatcatttaattgctaaagagatggaacataatacagtgtgtgctgctggtactagtcctgttggggaaattggtgaagagaaaattttgcccaccagtgagactaaacagcgcacagtattggatacctaccctggtgttagtgaagctgatgcaggagaaactctatcttctactggtccttttgctctggaacctgatgcaacaggaactagtaagggtattgaatttaccacagcatctactctcagtttaagttaataaatattgatgttgatttatctttaactactcaagatactgaacatgacatggtaatttccaccagtcctantggtgggtagtgaaacctnacattgaangggcctttgcctgcntaaagaaattcaatcttggatttaccatctaatataacccttgttagtaaaggatc

SEQ ID NO: 391 - DNA, 650 bp, Homo sapiens
  misc_feature (15)..(15): n is a, c, g, or t/u
  misc_feature (28)..(28): n is a, c, g, or t/u
  misc_feature (31)..(31): n is a, c, g, or t/u
  misc_feature (34)..(34): n is a, c, g, or t/u
  misc_feature (40)..(40): n is a, c, g, or t/u
  misc_feature (54)..(54): n is a, c, g, or t/u
  misc_feature (56)..(56): n is a, c, g, or t/u
  misc_feature (86)..(87): n is a, c, g, or t/u
  misc_feature (89)..(89): n is a, c, g, or t/u
  misc_feature (95)..(95): n is a, c, g, or t/u
  misc_feature (99)..(99): n is a, c, g, or t/u
  misc_feature (102)..(102): n is a, c, g, or t/u
  misc_feature (107)..(107): n is a, c, g, or t/u
  misc_feature (115)..(115): n is a, c, g, or t/u
  misc_feature (118)..(118): n is a, c, g, or t/u
  misc_feature (120)..(120): n is a, c, g, or t/u
  misc_feature (122)..(122): n is a, c, g, or t/u
  misc_feature (128)..(128): n is a, c, g, or t/u
  misc_feature (172)..(172): n is a, c, g, or t/u
  misc_feature (177)..(177): n is a, c, g, or t/u
  misc_feature (183)..(183): n is a, c, g, or t/u
  misc_feature (248)..(248): n is a, c, g, or t/u
  misc_feature (253)..(253): n is a, c, g, or t/u
  misc_feature (255)..(255): n is a, c, g, or t/u
  misc_feature (287)..(287): n is a, c, g, or t/u
  misc_feature (295)..(295): n is a, c, g, or t/u
  misc_feature (303)..(303): n is a, c, g, or t/u
  misc_feature (330)..(330): n is a, c, g, or t/u
  misc_feature (335)..(336): n is a, c, g, or t/u
  misc_feature (339)..(339): n is a, c, g, or t/u
  misc_feature (347)..(347): n is a, c, g, or t/u
  misc_feature (353)..(353): n is a, c, g, or t/u
  misc_feature (364)..(364): n is a, c, g, or t/u
  misc_feature (368)..(368): n is a, c, g, or t/u
  misc_feature (375)..(376): n is a, c, g, or t/u
  misc_feature (385)..(386): n is a, c, g, or t/u
  misc_feature (393)..(394): n is a, c, g, or t/u
  misc_feature (403)..(403): n is a, c, g, or t/u
  misc_feature (416)..(416): n is a, c, g, or t/u
  misc_feature (428)..(428): n is a, c, g, or t/u
  misc_feature (433)..(433): n is a, c, g, or t/u
  misc_feature (438)..(439): n is a, c, g, or t/u
  misc_feature (446)..(446): n is a, c, g, or t/u
  misc_feature (452)..(452): n is a, c, g, or t/u
  misc_feature (469)..(471): n is a, c, g, or t/u
  misc_feature (477)..(478): n is a, c, g, or t/u
  misc_feature (482)..(482): n is a, c, g, or t/u
  misc_feature (487)..(488): n is a, c, g, or t/u
  misc_feature (493)..(494): n is a, c, g, or t/u
  misc_feature (500)..(500): n is a, c, g, or t/u
  misc_feature (514)..(514): n is a, c, g, or t/u
  misc_feature (526)..(526): n is a, c, g, or t/u
  misc_feature (552)..(552): n is a, c, g, or t/u
  misc_feature (557)..(557): n is a, c, g, or t/u
  misc_feature (562)..(562): n is a, c, g, or t/u
  misc_feature (567)..(567): n is a, c, g, or t/u
  misc_feature (569)..(569): n is a, c, g, or t/u
  misc_feature (571)..(571): n is a, c, g, or t/u
  misc_feature (577)..(577): n is a, c, g, or t/u
  misc_feature (579)..(580): n is a, c, g, or t/u
  misc_feature (585)..(585): n is a, c, g, or t/u
  misc_feature (591)..(591): n is a, c, g, or t/u
  misc_feature (618)..(618): n is a, c, g, or t/u
  misc_feature (632)..(632): n is a, c, g, or t/u
  misc_feature (634)..(634): n is a, c, g, or t/u
  misc_feature (647)..(647): n is a, c, g, or t/u
catagccaacaaaanaatggctggttgncanggntattantataagaggggttncngcattttaattatcattctacgtctatctnngngatggngaanttnaaaangcacattnaantnanactatntcacaactcaatgccatactaaatgtacttggcctctgcaatanaattntagtcngacttcattttttactcccttcttatgacccaagtggctttaacaggaatgcaggacttattgcngatcntnacacaacataccactttctttttagaaccttnacaaaatnttgagggnagatggtggcattagccctcgtggaanagatnntgntcacctcnataacnctggcccattntctntccagcnnaacccattnngaaatanncaaggggcncagcccttcctgnttacaggcaaantgttncagtnncctaccntaaggnaggggagttcatccttnnnaaaacnntggngttanngcgtnntttaanattccccactgaanaataccctgatncctttcaaacagtcgtttggatgttngcccnttaancaaancntnacttangnngaacnattttnacttaccaaaacctgtttggtgtaaanacaatttccatggngncaaaaaattaaangcc

SEQ ID NO: 392 - DNA, 1257 bp, Homo sapiens
  misc_feature (518)..(518): n is a, c, g, or t/u
  misc_feature (570)..(570): n is a, c, g, or t/u
  misc_feature (581)..(581): n is a, c, g, or t/u
  misc_feature (586)..(586): n is a, c, g, or t/u
  misc_feature (599)..(599): n is a, c, g, or t/u
  misc_feature (615)..(615): n is a, c, g, or t/u
  misc_feature (621)..(621): n is a, c, g, or t/u
  misc_feature (1123)..(1123): n is a, c, g, or t/u
  misc_feature (1228)..(1228): n is a, c, g, or t/u
gctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaanaagcgctggaacagcattgaggagcggcgcatccaccaagaaagcgagctgnacttctacctnttcangcttattgccgcngaccgtgaaaggaagntgaaanagtgccaaggaaaccacgaggggtatgaggacgacaagccacgtccggggcccagcaggcttgcattgaggccaagcacgacaagtacatggcggacatggacgagctttttttttcaggtggatgaaagaggaagaagcgagacatccccgacttacctgtgtggcaagatcagctttgagccgatgcgggagccgtgcatcacgcccagtggcatcacctacgaccgcaaggacatcgaggagcacctgcagcgtgtgggtcattttgaccccgtgacccggagccccctgacccaggaacagctcatccccaacttggctatgaaggaggttattgacgcattcatctctgagaatggctgggtggaggactactgaggttccctgccctacctggcgtcctggtccaggggagccctgggcagaagcccccggcccctatacatagtttatgttcctggccaccccgaccgcttcccccaagttctgctgttggactntggactgtttcccctctcagcatcgcttttgctgggccgtgatcgtccccctttgtgggctggaaaagcaggtgagggtgggctgggctgaggccattgccgccnctatctgtgtaataaaatccgtgagcacg

SEQ ID NO: 393 - DNA, 837 bp, Homo sapiens
  misc_feature (700)..(700): n is a, c, g, or t/u
  misc_feature (803)..(803): n is a, c, g, or t/u
gttacacaggagtttactcagtattgggctcaacgggaagctgactttaaggagactctgcttcaagaacgagagatattagaagaaaatgctgaacgtcgtttggctatcttcaaggatttggttggtaaatgtgacactcgagaagaagcagcgaaagacatttgtgccacaaaagttgaaactgaagaagctactgcttgtttagaactaaagtttaatcaaattaaagctgaattagctaaaaccaaaggagaattaatcaaaaccaaagaagagttaaaaaagagagaaaatgaatcagattcattgattcaagagcttgagacatctaataagaaaataattacacagaatcaaagaattaaagaattgataaatataattgatcaaaaagaagatactatcaacgaatttcagaacctaaagtctcatatggaaaacacatttaaatgcaatgacaaggctgatacatcttctttaataataaacaataaattgatttgtaatgaaacagttgaagtacctaaggacagcaaatctaaaatctgttcagaaagaaaaagagtaaatgaaaatgaacttcagcaagatgaaccaccagcaaagaaagggtctatccattgtagttcagcttcactgaagaccaaaagaaaagtggaagaagtgcgacccgaacattgcagaaaattgaagacantcagagttttacaaggaaaaataatgaagggactggagagcattttttcctcactatttgagaatgaccttaaaaaatgaaaagggaagaaaaagccgaattnaataaacccgattggtcattttcaaccaggaacc

SEQ ID NO: 394 - DNA, 722 bp, Homo sapiens
  misc_feature (571)..(571): n is a, c, g, or t/u
  misc_feature (595)..(595): n is a, c, g, or t/u
  misc_feature (635)..(635): n is a, c, g, or t/u
  misc_feature (652)..(652): n is a, c, g, or t/u
  misc_feature (683)..(683): n is a, c, g, or t/u
  misc_feature (710)..(710): n is a, c, g, or t/u
gaagtaaatgtttcatatcttgcaaattatttgttaactgtgtgatttcttctttcagcttgagttcctttacatttaaatctttggtgtttttgacagaatcctgaagatgttcttgaaattccttcaaatttctttctagctttaagatgatagattccttttccaaaatgtcttgttctaacttggctgaatgactacattcaactttctgagtctctaaaattgtttcaagttcctttatttttgccttatagcaagtaacaccttgtgtaagttctgaaagcgctctctttccttcaactacatgctgtatttgaacatcaagagtaacatttttttcttgcaattcttctttcagctgctgtataagagtttctttttcttttagtaggtcatcttggtttttatgctccttctcctttagtctattgttttcatccttatagccttttacttctgcctgcaatttttcaatttgttgttccagttcctcaatctgatgactttttttggaagaggccttcacaatctctttacattcttcccaaataggcttcaatactagagnggaaagaattttccctattggggntcttgaattcgaaattctttaacttgcttacttacccaanaatcattaccctaaaanggctaactggggtttttggcaaaatattctnctcaaaaccatttggaaaaaccctggngaatgggccaaa

SEQ ID NO: 395 - DNA, 712 bp, Homo sapiens
  misc_feature (652)..(652): n is a, c, g, or t/u
  misc_feature (664)..(664): n is a, c, g, or t/u
ccggccacaggcctgttgttctcggaagggagaaagcaggacatttccccacgtaactcccagctctgggcctagagtgcgtgcatggcgaagtccccggagaactctaccctggaggagattctggggcagtatcaacggagtctccgggaacatgccagcagaagcattcaccaactgacatgtgccctgaaagaaggcgatgtcactattggagaagatgcaccaaatctttcttttagcaccagtgtgggaaatgaggacgccaggacagcctggcccgaattcaacagagccatgctgttaatcagctcaaagatttgttgcgccaacaagcagataaggaaagtgaagtatctccgtcaagaagaagaaaaatgtcccccttgaggtcattagaacatgaggaaaccaatatgcctactatgcacgaccttgttcatactattaatgaccagtctcaatatattcatcatttagaggcagaagttaaagttctgcaaggaggaactctctggaatgaaaaataaaatacaagtagttgtgcttgaaaaccaagggctcaaccacaacttaaatctcaagacaagaggagacctgagggaacaaccttctgatgcatccggaacatgccaattctggttacacaggngaaattctgggngggcgaacctcaaaaaacattttccatgcaatgcaaatttggcaaact

SEQ ID NO: 396 - DNA, 768 bp, Homo sapiens
  misc_feature (534)..(534): n is a, c, g, or t/u
  misc_feature (594)..(594): n is a, c, g, or t/u
  misc_feature (611)..(611): n is a, c, g, or t/u
  misc_feature (624)..(624): n is a, c, g, or t/u
  misc_feature (640)..(640): n is a, c, g, or t/u
  misc_feature (645)..(645): n is a, c, g, or t/u
  misc_feature (654)..(654): n is a, c, g, or t/u
  misc_feature (690)..(690): n is a, c, g, or t/u
  misc_feature (692)..(692): n is a, c, g, or t/u
  misc_feature (697)..(697): n is a, c, g, or t/u
  misc_feature (701)..(701): n is a, c, g, or t/u
  misc_feature (711)..(711): n is a, c, g, or t/u
  misc_feature (729)..(729): n is a, c, g, or t/u
  misc_feature (748)..(748): n is a, c, g, or t/u
ctttaaaaagttcatttattgaaaatcatatgtataacctagcatacgaatgagcagatttaaacacataacttcaagccatttctgaaaacatacaccaggagctctgctcagctagagtcagactccagctccagcccgactgcgtgcggggacagcgcccgcgttgatgaggaccagccccactgcaggctgaggcggtgtcaccctgggaaggtcgtggtgcgttgtggcatattaagtctaaaccagatgaatgtaaatatctctttgtaaatcatttatttcactctgttccatccaggtcagcaatcagattgtggcatgctgggtaactgggtccgcagccggtccacctcttccgacaggctctgcctctccaggagaagctggttctgcttgctgaggagctgcaccagctgctgggctgtggcctggctgtgcttatccagctgccttagcctttgcttcatcgtctcatgtactctcccatgctggacacactgttcctccaattcttcatttcttctctgnaactttcccaatttatcatatgtataccttttttcttgactgagttgaacctatttcaanatctggttttttgaganaatttgttccaantttcttgggctaatgnacagnatttctttncttttaacttttggcaaaaaatgtattcttggggangncagcnaccnaaataccggntcaattttcaagttttgncaatgcctgggctttccantttgctggaatcttttgggg

SEQ ID NO: 397 - DNA, 721 bp, Homo sapiens
  misc_feature (469)..(469): n is a, c, g, or t/u
  misc_feature (507)..(507): n is a, c, g, or t/u
  misc_feature (528)..(528): n is a, c, g, or t/u
  misc_feature (531)..(531): n is a, c, g, or t/u
  misc_feature (571)..(571): n is a, c, g, or t/u
  misc_feature (573)..(573): n is a, c, g, or t/u
  misc_feature (602)..(602): n is a, c, g, or t/u
  misc_feature (632)..(632): n is a, c, g, or t/u
  misc_feature (634)..(634): n is a, c, g, or t/u
  misc_feature (641)..(641): n is a, c, g, or t/u
  misc_feature (645)..(645): n is a, c, g, or t/u
  misc_feature (651)..(651): n is a, c, g, or t/u
  misc_feature (661)..(661): n is a, c, g, or t/u
  misc_feature (666)..(666): n is a, c, g, or t/u
  misc_feature (682)..(682): n is a, c, g, or t/u
  misc_feature (706)..(706): n is a, c, g, or t/u
  misc_feature (708)..(708): n is a, c, g, or t/u
aggaaactcgtctcttaatagcacatctaacactaaagtatcagcagtgcctacaaatatggctgccaagaaaacatctacccccaaaataaattttgttggtggtaataagctgcagtcaacaggaaataaagcagaagacacaaaaggaaccgaatgtgttaaaagtactcctgtcacttctgctgtgcagattcctgaagtaaagcaagacacagtgtcagaaccagtcacacctgcatctcttgctgctttacagagtgatgtgcagccagtgggccatgattatgtggaagaggtacgaaatgatgaaggaaaagtaattcggttccattgtaaattatgcgagtgcagctttaatgatcccaatgctaaggagatgcacttaaaagggcgaagacacagacttcaatataaaaaaaaagtaaatccagatttgcaagtagaagtaaagcctagtattcgagcnagaaagattcaagaagagaaaatgaggaagcaaatgcngaaggaggagtactggcgaanacnaaaagaaaaaggagcgttggagaatggaaatgagaccttntnaaaaagacatgttctggaggagaatggangaagaacaacattatttgggatgatcgccncnaatgccnaatngaggtnttctcatggncctcnaggccattaggccttntgggagtccaacagcatgcctctnanacttaaggggctg

SEQ ID NO: 398 - DNA, 742 bp, Homo sapiens
  misc_feature (633)..(633): n is a, c, g, or t/u
  misc_feature (687)..(687): n is a, c, g, or t/u
  misc_feature (717)..(717): n is a, c, g, or t/u
aaatttgaatatgattttactgaagcatacatcatttcaaagcaaaagtagtttatgttgtcaattctaacatataatacatttaagtcattatatgaatttcattttttgtgtatttcactgtagtgctgtgacaacaaaatgacatctgtgtaccagagcatacatatatcaacagtaagatgtaatttttcattacatcactgctagaatatttagctttgtgtaggagacataagcaggtaagatggccacaccaaataattttctgtttttttccttagataattttttatcagtaatactttatcaacctcactgttaacagaactgtaaattatctgggtgatggggtgtgtggagaagatcatctgtgttatactgtaatagttgctagagtaatctcacacacaccaataaggaactgtcaccataattaagggctagttactgttgttagttgtacaatgatgaagttcttttgaaaatattggttagcccacttatatgtgaaaaatgccctttccacttatacacaagaaaaaaatattcagaaagttatttttggccttgctatgtcaaaaagtcaactgtacaaagatctaccgtgttaaacctaaaattatgattttnaaagtctattaaaaaacaagaatgtcatgcatttttattatcaattatgcaaangctttaaaactgttgccagaacatataggnatatattagcttttatactgggtaa

SEQ ID NO: 399 - DNA, 677 bp, Homo sapiens
  misc_feature (514)..(514): n is a, c, g, or t/u
  misc_feature (537)..(537): n is a, c, g, or t/u
  misc_feature (544)..(544): n is a, c, g, or t/u
  misc_feature (546)..(547): n is a, c, g, or t/u
  misc_feature (605)..(605): n is a, c, g, or t/u
  misc_feature (620)..(620): n is a, c, g, or t/u
  misc_feature (633)..(633): n is a, c, g, or t/u
  misc_feature (646)..(646): n is a, c, g, or t/u
  misc_feature (650)..(650): n is a, c, g, or t/u
  misc_feature (652)..(652): n is a, c, g, or t/u
gagagagatgcggtgcagcgcgatttgcttgtaaatgcatcacgaagaggcagcccagaatgaagaaagcaagcaggagtgttggctcagtgcctaaagtgtctgcaataagtaaaacgcaaacagcagaaaaaattaaacctgaaaacagctcttcagcatctacgggaggcaaacttgtaaaacctggaacagcagcatcattgtcaaagaccaagagcagtgatgaccttttagctggaatggccggaggggtaacggtgactaatggtgttaaaggaaagaaaagcacctgcccatctgcagcaccttcagcatctgcccctgccatgaccaccgtggagaacaaatccaagattagcacaggcacagcttcttcaaccaagcggagcacttctacaggtcagggagctaatgacatggcattggccaaacgttcccgcagtcgaactgctacagaatgtgacgttcgtatgagcaagtcttagtcagacaatcaagatcagtgacaganctgctttggaggccaaagtgaangatcttntnncgctggccaaaaccaaagacgtagaaattttacattttgagaaaatgaactgggaganatgcgtgccccactnggcattaatgaangatcatttttgangggngntgaaaaaatcttgagaaaggaaact

SEQ ID NO: 400 - DNA, 670 bp, Homo sapiens
  misc_feature (520)..(520): n is a, c, g, or t/u
  misc_feature (549)..(549): n is a, c, g, or t/u
  misc_feature (566)..(566): n is a, c, g, or t/u
  misc_feature (569)..(569): n is a, c, g, or t/u
  misc_feature (616)..(616): n is a, c, g, or t/u
aattaatagaggcagaaggaatagaagatatagaaaaagaggacatcgaaagtcaggaaattgaagctcaagaaggtgaagatgatacctttctaacagcccaagatggtgaggaagaagaaaatgagaaagatatagcaggttctggtgatggtacacaagaagtatctaaacctcttccttcagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctangaaagcagaatctggagaccaaagaaaangatacttttgaagaaanggncctcgctactggggccctctggtcaaagccaaaagagctcttcaaanggaattcttaaagacagccaaggacatcatcttaaggatgaccaaaaggaaagt

SEQ ID NO: 401 - DNA, 709 bp, Homo sapiens
  misc_feature (3)..(3): n is a, c, g, or t/u
  misc_feature (199)..(199): n is a, c, g, or t/u
  misc_feature (374)..(374): n is a, c, g, or t/u
  misc_feature (393)..(393): n is a, c, g, or t/u
  misc_feature (418)..(418): n is a, c, g, or t/u
  misc_feature (429)..(429): n is a, c, g, or t/u
  misc_feature (489)..(489): n is a, c, g, or t/u
  misc_feature (627)..(627): n is a, c, g, or t/u
  misc_feature (661)..(661): n is a, c, g, or t/u
  misc_feature (668)..(668): n is a, c, g, or t/u
  misc_feature (671)..(671): n is a, c, g, or t/u
  misc_feature (682)..(682): n is a, c, g, or t/u
canatttctcagacgatcttttctcttcttttttgacagaggcttgtgtcttgctacttctatcactcgtattttttttatctccagaacttcttgaactactcttttcatcattttctttcttcatttctttcttagagggatcaccttttactttttcaacagaaatcagctgtccatgcagctcagtgcgatgaanatgtgcaatacacctggacacctctgtgcttgaagacatagttacaatgccatagcattttgccccaggacttcgagcatttgtaactacttttgcactcagaacctttccatatttgccaaagaggttcttcaaatcagcagctttggtattagatgaaagtccactaacccanatatttttagttgagcttncactgctaccactagtactacttgnacttcctttgncatctttagatgatgtcttgctgtctttagattcctttgaagagctctttgcttgaccanaggccccagtagacgagggccctttcttcaaagtatccttttctttgtctccagattctgctttcttagaactttctctggcttccttctcgacagggtcacccttcacgcagtcttccttcttaccatctttatggntcgcattcatctcataatccttgctttccttctncgggctntgngcaatggcggnccggcccatcttttggcttacttgctt

SEQ ID NO: 402 - DNA, 697 bp, Homo sapiens
  misc_feature (26)..(27): n is a, c, g, or t/u
  misc_feature (36)..(36): n is a, c, g, or t/u
  misc_feature (54)..(54): n is a, c, g, or t/u
  misc_feature (59)..(59): n is a, c, g, or t/u
  misc_feature (90)..(91): n is a, c, g, or t/u
  misc_feature (103)..(103): n is a, c, g, or t/u
  misc_feature (158)..(158): n is a, c, g, or t/u
  misc_feature (167)..(167): n is a, c, g, or t/u
  misc_feature (177)..(177): n is a, c, g, or t/u
  misc_feature (188)..(188): n is a, c, g, or t/u
  misc_feature (194)..(194): n is a, c, g, or t/u
  misc_feature (206)..(206): n is a, c, g, or t/u
  misc_feature (213)..(214): n is a, c, g, or t/u
  misc_feature (226)..(226): n is a, c, g, or t/u
  misc_feature (246)..(247): n is a, c, g, or t/u
  misc_feature (258)..(258): n is a, c, g, or t/u
  misc_feature (265)..(265): n is a, c, g, or t/u
  misc_feature (279)..(279): n is a, c, g, or t/u
  misc_feature (283)..(283): n is a, c, g, or t/u
  misc_feature (287)..(287): n is a, c, g, or t/u
  misc_feature (309)..(309): n is a, c, g, or t/u
  misc_feature (312)..(312): n is a, c, g, or t/u
  misc_feature (321)..(322): n is a, c, g, or t/u
  misc_feature (328)..(328): n is a, c, g, or t/u
  misc_feature (341)..(341): n is a, c, g, or t/u
  misc_feature (346)..(346): n is a, c, g, or t/u
  misc_feature (352)..(352): n is a, c, g, or t/u
  misc_feature (368)..(368): n is a, c, g, or t/u
  misc_feature (371)..(373): n is a, c, g, or t/u
  misc_feature (377)..(377): n is a, c, g, or t/u
  misc_feature (385)..(386): n is a, c, g, or t/u
  misc_feature (390)..(390): n is a, c, g, or t/u
  misc_feature (392)..(393): n is a, c, g, or t/u
  misc_feature (396)..(396): n is a, c, g, or t/u
  misc_feature (409)..(409): n is a, c, g, or t/u
  misc_feature (417)..(418): n is a, c, g, or t/u
  misc_feature (421)..(421): n is a, c, g, or t/u
  misc_feature (426)..(426): n is a, c, g, or t/u
  misc_feature (429)..(429): n is a, c, g, or t/u
  misc_feature (434)..(434): n is a, c, g, or t/u
  misc_feature (444)..(444): n is a, c, g, or t/u
  misc_feature (448)..(448): n is a, c, g, or t/u
  misc_feature (452)..(452): n is a, c, g, or t/u
  misc_feature (458)..(458): n is a, c, g, or t/u
  misc_feature (461)..(461): n is a, c, g, or t/u
  misc_feature (486)..(486): n is a, c, g, or t/u
  misc_feature (537)..(537): n is a, c, g, or t/u
  misc_feature (554)..(554): n is a, c, g, or t/u
  misc_feature (564)..(564): n is a, c, g, or t/u
  misc_feature (568)..(568): n is a, c, g, or t/u
  misc_feature (570)..(570): n is a, c, g, or t/u
  misc_feature (573)..(573): n is a, c, g, or t/u
  misc_feature (585)..(586): n is a, c, g, or t/u
  misc_feature (592)..(592): n is a, c, g, or t/u
  misc_feature (594)..(594): n is a, c, g, or t/u
  misc_feature (609)..(609): n is a, c, g, or t/u
  misc_feature (620)..(620): n is a, c, g, or t/u
  misc_feature (631)..(631): n is a, c, g, or t/u
  misc_feature (636)..(636): n is a, c, g, or t/u
  misc_feature (640)..(640): n is a, c, g, or t/u
  misc_feature (650)..(650): n is a, c, g, or t/u
  misc_feature (654)..(655): n is a, c, g, or t/u
  misc_feature (665)..(665): n is a, c, g, or t/u
  misc_feature (671)..(672): n is a, c, g, or t/u
  misc_feature (674)..(674): n is a, c, g, or t/u
  misc_feature (679)..(679): n is a, c, g, or t/u
  misc_feature (686)..(687): n is a, c, g, or t/u
  misc_feature (691)..(691): n is a, c, g, or t/u
gctgcctccgccgccgcggggcacanntttgggcanggagcccatcgaggggcncgcgngggcgcgggcatgggactgcgccggatccgnngacagcatgganccaagcggcccgggccctgagcgcgtattctccggggggcctcgccctcctgctngcggggccngggctcctgntccggttgctngcgctnatgctggctgtngcggcgnncagcatcatgtngggtcgccgcatgccctcgnnggagggagcangcctgcncgagcgccaatggncgangccntgtgagcccagacgtccgatanctnttccgaagnngtgccncaaccggggacgnggaangagttnaacaggctggtgactnctnnnaaangagaacannctcnannccngcgggctggaaanccaccccnntgnatttnacngaaanttttgggcgnaaanacanaagttnaanatttgcttcaaaatgggtgcaaatntccaaacacctgatagatgggaggccttattcctcttaataaggcatcctntttttggtatattcctngaaaataatngaantnttnctttttgaagannttgggncnatacccccaattgcnttgaaaataanttggaaattantactncctnttcatgaaancctnnaatttaaaanggaaannanttgantggtttnnccanttgttc

SEQ ID NO: 403 - DNA, 623 bp, Homo sapiens
  misc_feature (518)..(518): n is a, c, g, or t/u
  misc_feature (570)..(570): n is a, c, g, or t/u
  misc_feature (581)..(581): n is a, c, g, or t/u
  misc_feature (586)..(586): n is a, c, g, or t/u
  misc_feature (599)..(599): n is a, c, g, or t/u
  misc_feature (608)..(608): n is a, c, g, or t/u
gctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaanaagcgctggaacagcattgaggagcggcgcatccaccaagaaagcgagctgnacttctacctnttcangcttattgccgcngaccgtganaaggaaacttgaaaa

SEQ ID NO: 404 - DNA, 703 bp, Homo sapiens
  misc_feature (30)..(30): n is a, c, g, or t/u
  misc_feature (135)..(135): n is a, c, g, or t/u
  misc_feature (637)..(637): n is a, c, g, or t/u
  misc_feature (643)..(643): n is a, c, g, or t/u
  misc_feature (696)..(696): n is a, c, g, or t/u
  misc_feature (698)..(698): n is a, c, g, or t/u
cgtgctcacggattttattacacagatagnggcggcaatggcctcagcccagcccaccctcacctgcttttccagcccacaaagggggacgatcacggcccagcaaaagcgatgctgagaggggaaacagtccanagtccaacagcagaacttgggggaagcggtcggggtggccaggaacataaactatgtataggggccgggggcttctgcccagggctcccctggaccaggacgccaggtagggcagggaacctcagtagtcctccacccagccattctcagagatgaatgcgtcaataacctccttcatagccaagttggggatgagctgttcctgggtcagggggctccgggtcacggggtcaaaatgacccacacgctgcaggtgctcctcgatgtccttgcggtcgtaggtgatgccactgggcgtgatgcacggctcccgcatcggctcaaagctgatcttgccacacaggtaagtcggggatgtctcgcttcttcctctttcatccacctgaaaaaaaaagctcgtccatgtccgccatgtacttgtcgtgcttggcctcaatgcaagcctgctgggccccggacgtggcttgtcgtcctcatacccctcgtggtttccttggcactntttcancttcctttcacgcttccgcgggaattaacctggaaaggaagaatgcacttccntntctgg

SEQ ID NO: 405 - DNA, 700 bp, Homo sapiens
  misc_feature (604)..(604): n is a, c, g, or t/u
  misc_feature (636)..(636): n is a, c, g, or t/u
aacctcaaaggaattctagaagaatctccatctgaagcagaagatttcatttctggaattacacagactatggtagaagctgtagctgaagtagaaaaaaatgaaactgtttcggaaatattgccatcaacttgtattgtgacgttagtaccaggaattcccactggggatgagaagacagtggacaaaaagaatatttctgaaaaaaaaggtaacatggatgaaaaggaggagaaggaatttaatactaaggaaaccagaatggatcttcaaataggaacagagaaggctgaaaagaatgaaggtaggatggatgcagaaaaggtggaaaagatggcagcaatgaaagaaaagcctgcagaaaacactttattcaaggcatacccaaataaaggagtgggtcaggctaataagcctgatgaaactagtaaaactagtattctggctgtatcagatgtatctagcagtaaaccaagcatcaaggctgttatagtctcttctcctaaggcaaaagctacagtttcaaaaactgaaaatcagaaaagttttccaaaatctgtgcccagagatcaaataaatgctgaaaagaaactttcagcccaangaatttggtctgcttaaacccacaagtgccangtcaggctttggcagaaagccagcagtaaattcaaacctactcagagccagtcttaccaaagga

SEQ ID NO: 406 - DNA, 725 bp, Homo sapiens
  misc_feature (650)..(650): n is a, c, g, or t/u
  misc_feature (652)..(652): n is a, c, g, or t/u
  misc_feature (658)..(658): n is a, c, g, or t/u
  misc_feature (674)..(674): n is a, c, g, or t/u
ggattttaaatatacagtaggaacatttattttaacacttctaaaagatatttctccatgcctgatgatttgatataaaaatcaaacccatcatactttccccatcagtctctctacatttagggcaatcagaaatttgtacaacacgaatatttgcttctgaaacgaaaattacaaattaaatgataacaaaaatacacaaatcaactggaccctaaacaaatttctagtgaattctttcctttcccccaatcacctagagcttctttcttcagcctcattctgctccttttcctttctttgcttggccatgaatttctcagtattttgcttatgacgtgtactcttgcagtgatttgtcattgttttttcacctgagtagaagagggaacaaattggacagaagaatccagccttaggtcaagaaagtctaattcctcagggacatcagacgccactgatttgcctgaagaagagtcttcagtcttcttgcgttttcgctctggttctgaatcctttaatccagattcctcatcaacttcactcatctggaaggcctcttcaccttttgctggttctgcacaacagctttttctgatggcagagttttccaattctaactctctttgggtggagtttagctgttaaangnctttcnatcatgggttttagancttcttccataacattctcatttactgggcccactttgggacaaggattca

SEQ ID NO: 407 - DNA, 761 bp, Homo sapiens
  misc_feature (131)..(131): n is a, c, g, or t/u
  misc_feature (149)..(149): n is a, c, g, or t/u
  misc_feature (287)..(287): n is a, c, g, or t/u
  misc_feature (568)..(568): n is a, c, g, or t/u
  misc_feature (651)..(651): n is a, c, g, or t/u
  misc_feature (676)..(676): n is a, c, g, or t/u
  misc_feature (696)..(696): n is a, c, g, or t/u
  misc_feature (733)..(734): n is a, c, g, or t/u
gtttttttttttttttttaacctttccttatgagcatgcctgtgttgggttgacagtgagggtaataatgacttgttggttgattgtagatattgggctgttaattgtcagttcagtgttttaatctgacncaggcttatgcggagganaatgttttcatgttacttatactaacattagttcttctatagggtgatagattggtccaattgggtgtgaggagttcagttatatgtttgggattttttaggcagtgggtgttgagcttgaacgctttcttaattggnggctgcttttaggcctactatgggtgttaaattttttactctctctacaaggttttttcctagtgtccaaagagctgttcctctttggactaacagttaaatcagaatcataggcatatgattacaccctatggttatggaaaaaaacgaatattcatatttagtattatgacctaagtgtatatccaagctgatcaattcataacacttcagtgatgagatgtcagttgtacattcggctgaactctcatcataactatgtcctttccaaagataggctntattaaagaacaggatgaatggaataatataaagtgattctaatgtggtttcattaagtacgtggcgtaccattccatgttcnaccttttgacatttattttctcatntcaacccctttttacacgtngaaacacaatctcgctcttgaagtcttactgcctgannttgggaaaccctgtatttaatattttc

SEQ ID NO: 408 - DNA, 737 bp, Homo sapiens
  misc_feature (2)..(3): n is a, c, g, or t/u
  misc_feature (6)..(7): n is a, c, g, or t/u
  misc_feature (20)..(20): n is a, c, g, or t/u
  misc_feature (22)..(22): n is a, c, g, or t/u
  misc_feature (26)..(27): n is a, c, g, or t/u
  misc_feature (38)..(38): n is a, c, g, or t/u
  misc_feature (41)..(41): n is a, c, g, or t/u
  misc_feature (43)..(43): n is a, c, g, or t/u
  misc_feature (47)..(47): n is a, c, g, or t/u
  misc_feature (53)..(53): n is a, c, g, or t/u
  misc_feature (68)..(68): n is a, c, g, or t/u
  misc_feature (76)..(76): n is a, c, g, or t/u
  misc_feature (78)..(78): n is a, c, g, or t/u
  misc_feature (81)..(81): n is a, c, g, or t/u
  misc_feature (86)..(86): n is a, c, g, or t/u
  misc_feature (88)..(88): n is a, c, g, or t/u
  misc_feature (101)..(101): n is a, c, g, or t/u
  misc_feature (119)..(119): n is a, c, g, or t/u
  misc_feature (125)..(125): n is a, c, g, or t/u
  misc_feature (139)..(139): n is a, c, g, or t/u
  misc_feature (153)..(153): n is a, c, g, or t/u
  misc_feature (158)..(158): n is a, c, g, or t/u
  misc_feature (166)..(166): n is a, c, g, or t/u
  misc_feature (170)..(170): n is a, c, g, or t/u
  misc_feature (174)..(174): n is a, c, g, or t/u
  misc_feature (189)..(189): n is a, c, g, or t/u
  misc_feature (198)..(199): n is a, c, g, or t/u
  misc_feature (213)..(214): n is a, c, g, or t/u
  misc_feature (217)..(218): n is a, c, g, or t/u
  misc_feature (223)..(223): n is a, c, g, or t/u
  misc_feature (226)..(226): n is a, c, g, or t/u
  misc_feature (228)..(228): n is a, c, g, or t/u
  misc_feature (236)..(236): n is a, c, g, or t/u
  misc_feature (238)..(238): n is a, c, g, or t/u
  misc_feature (249)..(249): n is a, c, g, or t/u
  misc_feature (252)..(252): n is a, c, g, or t/u
  misc_feature (254)..(254): n is a, c, g, or t/u
  misc_feature (259)..(259): n is a, c, g, or t/u
  misc_feature (264)..(264): n is a, c, g, or t/u
  misc_feature (266)..(266): n is a, c, g, or t/u
  misc_feature (270)..(270): n is a, c, g, or t/u
  misc_feature (274)..(274): n is a, c, g, or t/u
  misc_feature (277)..(277): n is a, c, g, or t/u
  misc_feature (282)..(282): n is a, c, g, or t/u
  misc_feature (284)..(284): n is a, c, g, or t/u
  misc_feature (286)..(286): n is a, c, g, or t/u
  misc_feature (303)..(303): n is a, c, g, or t/u
  misc_feature (307)..(307): n is a, c, g, or t/u
  misc_feature (310)..(311): n is a, c, g, or t/u
  misc_feature (319)..(319): n is a, c, g, or t/u
  misc_feature (321)..(321): n is a, c, g, or t/u
  misc_feature (327)..(327): n is a, c, g, or t/u
  misc_feature (332)..(332): n is a, c, g, or t/u
  misc_feature (335)..(336): n is a, c, g, or t/u
  misc_feature (341)..(341): n is a, c, g, or t/u
  misc_feature (349)..(350): n is a, c, g, or t/u
  misc_feature (354)..(354): n is a, c, g, or t/u
  misc_feature (368)..(369): n is a, c, g, or t/u
  misc_feature (387)..(387): n is a, c, g, or t/u
  misc_feature (399)..(399): n is a, c, g, or t/u
  misc_feature (408)..(408): n is a, c, g, or t/u
  misc_feature (411)..(411): n is a, c, g, or t/u
  misc_feature (427)..(427): n is a, c, g, or t/u
  misc_feature (429)..(430): n is a, c, g, or t/u
  misc_feature (435)..(435): n is a, c, g, or t/u
  misc_feature (441)..(441): n is a, c, g, or t/u
  misc_feature (448)..(449): n is a, c, g, or t/u
  misc_feature (452)..(452): n is a, c, g, or t/u
  misc_feature (454)..(454): n is a, c, g, or t/u
  misc_feature (463)..(464): n is a, c, g, or t/u
  misc_feature (467)..(467): n is a, c, g, or t/u
  misc_feature (480)..(481): n is a, c, g, or t/u
  misc_feature (491)..(491): n is a, c, g, or t/u
  misc_feature (497)..(497): n is a, c, g, or t/u
  misc_feature (500)..(500): n is a, c, g, or t/u
  misc_feature (506)..(506): n is a, c, g, or t/u
  misc_feature (508)..(508): n is a, c, g, or t/u
  misc_feature (512)..(512): n is a, c, g, or t/u
  misc_feature (519)..(519): n is a, c, g, or t/u
  misc_feature (524)..(524): n is a, c, g, or t/u
  misc_feature (529)..(529): n is a, c, g, or t/u
  misc_feature (534)..(534): n is a, c, g, or t/u
  misc_feature (540)..(541): n is a, c, g, or t/u
  misc_feature (573)..(574): n is a, c, g, or t/u
  misc_feature (579)..(579): n is a, c, g, or t/u
  misc_feature (585)..(586): n is a, c, g, or t/u
  misc_feature (588)..(588): n is a, c, g, or t/u
  misc_feature (599)..(599): n is a, c, g, or t/u
  misc_feature (601)..(601): n is a, c, g, or t/u
  misc_feature (620)..(620): n is a, c, g, or t/u
  misc_feature (622)..(622): n is a, c, g, or t/u
  misc_feature (624)..(624): n is a, c, g, or t/u
  misc_feature (627)..(627): n is a, c, g, or t/u
  misc_feature (656)..(656): n is a, c, g, or t/u
  misc_feature (660)..(660): n is a, c, g, or t/u
  misc_feature (662)..(662): n is a, c, g, or t/u
  misc_feature (669)..(670): n is a, c, g, or t/u
  misc_feature (678)..(679): n is a, c, g, or t/u
  misc_feature (681)..(681): n is a, c, g, or t/u
  misc_feature (685)..(685): n is a, c, g, or t/u
  misc_feature (687)..(687): n is a, c, g, or t/u
  misc_feature (697)..(697): n is a, c, g, or t/u
  misc_feature (712)..(712): n is a, c, g, or t/u
  misc_feature (715)..(717): n is a, c, g, or t/u
  misc_feature (723)..(723): n is a, c, g, or t/u
  misc_feature (734)..(734): n is a, c, g, or t/u
gnnacnnattctcgctctgncncccnngctggagtgcnaancnagantctggntggattgaatgatgnctgctgcntnatnagggnanatgggaatcctgngccgctttatgccattcntgaacnagtaattcttcacnctggtattttatgnctggnggcttcangaanaaancatgaatttttcttntaaaataannattctggtgacccnnacnnttggnaanantttcaacntnaggggatgctnggncnggccncctancntganttgngantaaanancngggctggtggttctccnaaanaannttcttacngnttggcnctcanganntttcnggttctgnnttcnctttttcatattgnnatataccggtttttaaangggtattggaantaaatatcnccncatttttctcttttangnnaaganggtgcnttttccnntcnanaaaatgaanntcnattggtatcttgnntttggtggcngctttnttntgggcntnaacnaattgcnggtgnagccncatanttttgnnttggaggtgaaaaaatttctgaaccaaaaacnnctgcngggtcnngnggggttggtcncnttatcttggtccgttttgnancnttngttccaacttccctcatttggcccttggnttcncngtgggcnntttgggcnngntccngnaaacccatgntttttctttttaaanccnnntcccgncctaaatgganatt

SEQ ID NO: 409 - DNA, 712 bp, Homo sapiens
  misc_feature (486)..(486): n is a, c, g, or t/u
  misc_feature (510)..(510): n is a, c, g, or t/u
  misc_feature (591)..(591): n is a, c, g, or t/u
  misc_feature (601)..(601): n is a, c, g, or t/u
  misc_feature (632)..(632): n is a, c, g, or t/u
  misc_feature (635)..(635): n is a, c, g, or t/u
  misc_feature (649)..(649): n is a, c, g, or t/u
  misc_feature (671)..(671): n is a, c, g, or t/u
  misc_feature (675)..(675): n is a, c, g, or t/u
  misc_feature (682)..(682): n is a, c, g, or t/u
  misc_feature (700)..(700): n is a, c, g, or t/u
  misc_feature (712)..(712): n is a, c, g, or t/u
gcggcccggcaagcggcggtgcggggtaggctgctttcctgaggccggactcaacgggtctcggctgagccaccgggtgagctcaccgcccagcccaaaccaggagattgcgagggagcgatgcggtgcagcgcgatttgcttgtaaatgcatcacgaagaggcagcccagaatgaagaaagcaagcaggagtgttggctcagtgcctaaagtgtctgcaataagtaaaacgcaaacagcagaaaaaattaaacctgaaaacagctcttcagcatctacgggaggcaaacttgtaaaacctggaacagcagcatcattgtcaaagaccaagagcagtgatgaccttttagctggaatggccggaggggtaacggtgactaatggtgttaaaggaaagaaaagcacctgcccatctgcagcaccttcagcatctgcccctgccatgaccaccgtggagaacaaatccaagattagcacaggcacagnttcttcaaccaagcggagcacttntacaggtaataaagaatccagttctactagagaaagattacgtgaacgtacccgattaaaccagagcaaaaaactaccttntgcaggtcanggagctaatgacatggcatttggccaaacgntcncccaattgaactgnttccaaaatgtgacgtttcgtntganccaagtnttaagtcagaccattccnaatccagtgacn

SEQ ID NO: 410 - DNA, 563 bp, Homo sapiens
  misc_feature (23)..(23): n is a, c, g, or t/u
  misc_feature (29)..(29): n is a, c, g, or t/u
  misc_feature (59)..(59): n is a, c, g, or t/u
  misc_feature (81)..(81): n is a, c, g, or t/u
  misc_feature (101)..(101): n is a, c, g, or t/u
  misc_feature (103)..(103): n is a, c, g, or t/u
  misc_feature (105)..(105): n is a, c, g, or t/u
  misc_feature (109)..(109): n is a, c, g, or t/u
  misc_feature (121)..(121): n is a, c, g, or t/u
  misc_feature (126)..(126): n is a, c, g, or t/u
  misc_feature (129)..(129): n is a, c, g, or t/u
  misc_feature (147)..(147): n is a, c, g, or t/u
  misc_feature (153)..(153): n is a, c, g, or t/u
  misc_feature (163)..(163): n is a, c, g, or t/u
  misc_feature (167)..(167): n is a, c, g, or t/u
  misc_feature (170)..(170): n is a, c, g, or t/u
  misc_feature (194)..(194): n is a, c, g, or t/u
  misc_feature (200)..(200): n is a, c, g, or t/u
  misc_feature (202)..(203): n is a, c, g, or t/u
  misc_feature (252)..(252): n is a, c, g, or t/u
  misc_feature (264)..(264): n is a, c, g, or t/u
  misc_feature (269)..(269): n is a, c, g, or t/u
  misc_feature (271)..(271): n is a, c, g, or t/u
  misc_feature (291)..(291): n is a, c, g, or t/u
  misc_feature (346)..(346): n is a, c, g, or t/u
  misc_feature (356)..(356): n is a, c, g, or t/u
  misc_feature (369)..(369): n is a, c, g, or t/u
  misc_feature (390)..(390): n is a, c, g, or t/u
  misc_feature (400)..(400): n is a, c, g, or t/u
  misc_feature (404)..(404): n is a, c, g, or t/u
  misc_feature (420)..(420): n is a, c, g, or t/u
  misc_feature (434)..(434): n is a, c, g, or t/u
  misc_feature (443)..(443): n is a, c, g, or t/u
  misc_feature (450)..(450): n is a, c, g, or t/u
  misc_feature (482)..(482): n is a, c, g, or t/u
  misc_feature (494)..(494): n is a, c, g, or t/u
  misc_feature (533)..(533): n is a, c, g, or t/u
  misc_feature (540)..(540): n is a, c, g, or t/u
  misc_feature (542)..(542): n is a, c, g, or t/u
  misc_feature (544)..(544): n is a, c, g, or t/u
cctcctccttctcctccttcctnttcctnttcttcttctttctctctctctcgtttttngtttttttggagggggcagganaggggggaacaggatttctntntnttgnccaggctgaagngcagnggngcaatcttggctcgctgnaacctntgcctggganacanagngatactccagcttaaaaaaaaaanggctgngnnaaaacagcaagttcctcccaagggctccaaaaagttgctgaccctcatnttccaaagtctnagctntntcagggtaacaaaactcagnccaaaaatttaaggaatgggctttgaagtcaggctgccctgggctactgcttaanaactaactgngttaacctgaatngaattagttaacttctttaancctcattttnggtntctataaaatgaggangacaataatacatntgccatgangaactgngaaaacagtgcctacaatggggaccctctctnttacccattatnacagctggcaggaaaaatgcattcatttaacaactcttnccccacntngnaattaaaatatccttacta

SEQ ID NO: 411 - DNA, 801 bp, Homo sapiens
  misc_feature (545)..(545): n is a, c, g, or t/u
  misc_feature (596)..(596): n is a, c, g, or t/u
  misc_feature (614)..(614): n is a, c, g, or t/u
  misc_feature (617)..(617): n is a, c, g, or t/u
  misc_feature (623)..(623): n is a, c, g, or t/u
  misc_feature (625)..(625): n is a, c, g, or t/u
  misc_feature (649)..(649): n is a, c, g, or t/u
  misc_feature (651)..(651): n is a, c, g, or t/u
  misc_feature (664)..(664): n is a, c, g, or t/u
  misc_feature (669)..(669): n is a, c, g, or t/u
  misc_feature (681)..(681): n is a, c, g, or t/u
  misc_feature (726)..(726): n is a, c, g, or t/u
  misc_feature (736)..(736): n is a, c, g, or t/u
  misc_feature (743)..(743): n is a, c, g, or t/u
  misc_feature (745)..(745): n is a, c, g, or t/u
  misc_feature (751)..(751): n is a, c, g, or t/u
  misc_feature (767)..(767): n is a, c, g, or t/u
ctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagaccccgagaattaaaagaacacttcccagaaggccaaaaaatctctcttgtggaaagaagaaatgattttccggnatggctgatgcaccccctctccagagattggtcccacccatagcctaagtnttttccctccacacaaanagnttcaangngcccttatgaaaggcataatgagngngatcctcaggttnggggnggaatttggagnaccttggccgctgtacaccccttggcaaaagtgcggccgttcctncccggagaanaccttgngnttgccnctcaataatctcaagnggaaaggaaaggattttgcccactttggacggtc

SEQ ID NO: 412 - DNA, 735 bp, Homo sapiens
  misc_feature (572)..(572): n is a, c, g, or t/u
  misc_feature (601)..(601): n is a, c, g, or t/u
  misc_feature (663)..(663): n is a, c, g, or t/u
  misc_feature (722)..(722): n is a, c, g, or t/u
attttgtacagttggtatttttaattctccattttttgttcacaaatgtagtcttcattttaatgaagaagagaagtctgtgtttcttccatgttgaactcctctgtccacttctgcaggtcttgtgcattatgcatcgtccataactttgcaaaatacttgagtctctttcttttcgtatttattaatccttccagctcttttgacttgtgagctgctttcttcaaaatttctccaggaacatctgctagtttagccacatttaatccataactccttgctgcaattcctctagttatttggtaaaggaaggtgacaaaatcagggacttgttctgctgtgcctggatccagtttgctttcatcctcactgaccaagaatcccatgtggtaattccccacctggtgtgagtaatttttttctagttcacaaactggcggataatgggtgacaaacagggttaaggatttcacatctctgatgaaatactcaagtgtagcataggcaatggcaattccatcatgaagtgctcgtccctcttcctaagttcatccaagataaccaaggactgngatggtgcttttctgattatttctgctgngtcagtcaagttcttccataaatggactccgtcctttatatatattggctgcagcacccatncttgtgaaaaatgccatcccacaatccaatttgtcgcttttttctggcagggaccttanggagccaatctgg

SEQ ID NO: 413 - DNA, 752 bp, Homo sapiens
  misc_feature (695)..(695): n is a, c, g, or t/u
  misc_feature (703)..(703): n is a, c, g, or t/u
  misc_feature (738)..(738): n is a, c, g, or t/u
tcaacgggtctcggctgagccaccgggtgagctcaccgcccagcccaaaccaggagattgcgagggagcgatgcggtgcagcgcgatttgcttgtaaatgcatcacgaagaggcagcccagaatgaagaaagcaagcaggagtgttggctcagtgcctaaagtgtctgcaataagtaaaacgcaaacagcagaaaaaattaaacctgaaaacagctcttcagcatctacgggaggcaaacttgtaaaacctggaacagcagcatcattgtcaaagaccaagagcagtgatgaccttttagctggaatggccggaggggtaacggtgactaatggtgttaaaggaaagaaaagcacctgcccatctgcagcaccttcagcatctgcccctgccatgaccaccgtggagaacaaatccaagattagcacaggcacagcttcttcaaccaagcggagcacttctacaggtagaggatgaataccgagccttcaagaagaagctaagaaacaaattgaagatttgaatatgacgttagaaaaattaagatcagacctggatgaaaaagaaacagaaaggagtgacatgaaagaaaccatctttgaacttgaagatgaagtagaacaacatcgtgctgtgaaacttcatgacaacctcattatttctgatctagagaatacaggtaaaaaactccagganccaaagcncgacatgggaaagagaaattaaagacacttcccangaaaactttcggaa

SEQ ID NO: 414 - DNA, 690 bp, Homo sapiens
  misc_feature (551)..(551): n is a, c, g, or t/u
  misc_feature (561)..(561): n is a, c, g, or t/u
  misc_feature (607)..(607): n is a, c, g, or t/u
  misc_feature (612)..(612): n is a, c, g, or t/u
  misc_feature (616)..(616): n is a, c, g, or t/u
  misc_feature (624)..(624): n is a, c, g, or t/u
  misc_feature (659)..(659): n is a, c, g, or t/u
  misc_feature (673)..(673): n is a, c, g, or t/u
  misc_feature (682)..(682): n is a, c, g, or t/u
  misc_feature (684)..(684): n is a, c, g, or t/u
aacctttccttatgagcatgcctgtgttgggttgacagtgagggtaataatgacttgttggttgattgtagatattgggctgttaattgtcagttcagtgttttaatctgacgcaggcttatgcggaggagaatgttttcatgttacttatactaacattagttcttctatagggtgatagattggtccaattgggtgtgaggagttcagttatatgtttgggattttttaggcagtgggtgttgagcttgaacgctttcttaattggtggctgcttttaggcctactatgggtgttaaattttttactctctctacaaggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccctattttgctacatagacgggtgtgctcttttagctggtcttaagtagctcgtctggtttcnggggtcttanctttggctcttcttgcaaaggtatttctagttaaatcattatgcanaaggnatangggggtangtccttgctatattatgcttgggtattaaattttnatcttttccttgcngggactatntntttttg

SEQ ID NO: 415 - DNA, 1243 bp, Homo sapiens
  misc_feature (1082)..(1082): n is a, c, g, or t/u
  misc_feature (1086)..(1086): n is a, c, g, or t/u
  misc_feature (1100)..(1100): n is a, c, g, or t/u
  misc_feature (1105)..(1105): n is a, c, g, or t/u
  misc_feature (1137)..(1137): n is a, c, g, or t/u
  misc_feature (1151)..(1151): n is a, c, g, or t/u
  misc_feature (1164)..(1164): n is a, c, g, or t/u
ctcacggacaagaacctcagataggttaaataggattgcgaatcaggtggccattcagcggaagaagcagtttgtggagcgagcccacagctactggctgctcaagcggctgtccaggaacggggcccccctgctgcggcggctgcagtccagcctgcagtctcagcgaagctcacagcagagagaaaatgatgaggagatgaaggctgccaaagagaagctgaagtactggcagcggctgcggcacgacctggagcgcgctcgcctgctgatcgagctgctgcgcaagcgggagaagctcaagcgtgagcaggtgaaggtggagcaggtcgccatggagctgcggctgaccccgctgacggtgctgctgcgctcagtgctggaccagctgcaagacaaggaccccgccaggatatttgcgcagcccgtgagtctgaaggaggtaccagattatttggatcacattaaacatcccatggactttgccacaatgaggaaacggttagaagctcaagggtataaaaacctccatgagtttgaggaggattttgatctcattatagataactgcatgaagtacaatgccagggacaccgtgttctatagagccgcggtgaggctgcgcgatcagggaggtgttgttctgaggcaggcccggcgcgaggtggacagcatcggcttggaagaggcctcggggatgcacctgcctgagcggcctgctgcggcaccgcggcggcctttctcctgggaagacgtggacaggttgctggaccccgccaacagagcccacctgggcctggaggagcagctgagagagctgctggacatgctcgacctcacctgcgctatgaagtccagcggctcccggagcaagcgggcaaagctgctcaaaaaggaaattgcccttctccgaaacaagctgagccagcagcacagccagcccctgcccacggggccaggcttggaaggcttcgaagaggacggagctgcgctggggcccggaggcgggcgaagaagtccttccgaggttggagactcttctgcagccaaggaaaaggtcgcggagcacatgcggagacttncgangtggaggaggagtncccangaaaagcgcctggacgcaggtcttcaccaacngcttttggggtgcnaagagccaaccangaacccggccgggggccttgggggaggaaggccacaccccgacgaccttgggccttcgagttcaagattttctttcaag

SEQ ID NO: 416 - DNA, 843 bp, Homo sapiens
  misc_feature (546)..(546): n is a, c, g, or t/u
  misc_feature (559)..(559): n is a, c, g, or t/u
  misc_feature (601)..(601): n is a, c, g, or t/u
  misc_feature (684)..(684): n is a, c, g, or t/u
  misc_feature (760)..(760): n is a, c, g, or t/u
  misc_feature (765)..(765): n is a, c, g, or t/u
  misc_feature (796)..(796): n is a, c, g, or t/u
  misc_feature (823)..(823): n is a, c, g, or t/u
gtatcgtggaaagggagagtggccactatgtggagatgcacgcccgctatatagggaccacagtgtttgtgcggcaggtgggtcgctacctgacccttgccatccgtatgcctgaagacctggccatgtcctacgaggagagccaggacctgcagctgtgcgtgaacggctgccccctgagtgaacgcatcgatgacgggcagggccaggtgtctgccatcctgggacacagcctgcctcgcacctccttggtgcaggcctggcctggctacacactggagactgccaacactcaatgccatgagaagatgccagtgaaggacatctatttccagtcctgtgtcttcgacctgctcaccactggtgatgccaactttactgccgcagcccacagtgccttggaggatgtggaggccctgcacccaaggaaggaacgctggcacattttccccagcagtggcaatgggactccccgtggaggcagtgatttgtctgtcagtctaggactcacctgcttgatccttatcgtgtttttgtaggggttgncttttgttttggntttttattttttgctataacaaaattttaaaatatatattgncataatatattgagtaaaagagtatatatgtatataccatgtatatgacaagatgtttgtcctgggacacccaccaagattgncatactgggtttggttggtttcacatatgttggatgtagggtctttgaatggatcaattttggttggaggttctgngaaangtttataatgtccttgccaaggacctggtanaaacactttattttttatatattaaanatttatggggggcctgggtg

SEQ ID NO: 417 - DNA, 1241 bp, Homo sapiens
ggagcgcgcacagtcggctcgcagcgcggcactacagcggccccggcccggcccccgcccggccccggcgcaggcagttcagattaaagaagctaattgatcaagaaatcaagtctcaggaggagaaggagcaagaaaaggagaaaagggtcaccaccctgaaagaggagctgaccaagctgaagtcttttgctttgatggtggtggatgaacagcaaaggctgacggcacagctcacccttcaaagacagaaaatccaagagctgaccacaaatgcaaaggaaacacataccaaactagcccttgctgaagccagagttcaggaggaagagcagaaggcaaccagactagagaaggaactgcaaacgcagaccacaaagtttcaccaagaccaagacacaattatggcgaagctcaccaatgaggacagtcaaaatcgccagcttcaacaaaagctggcagcactcagccggcagattgatgagttagaagagacaaacaggtctttacgaaaagcagaagaggagctgcaagatataaaagaaaaaatcagtaagggagaatatggaaacgctggtatcatggctgaagtggaagagctcaggaaacgtgtgctagatatggaagggaaagatgaagagctcataaaaatggaggagcagtgcagagatctcaataagaggcttgaaagggagacgttacagagtaaagactttaaactagaggttgaaaaactcagtaaaagaattatggctctggaaaagttagaagacgctttcaacaaaagcaaacaagaatgctactctctgaaatgcaatttagaaaaagaaaggatgaccacaaagcagttgtctcaagaactggagagtttaaaagtaaggatcaaagagctagaagccattgaaagtcggctagaaaagacagaattcactctaaaagaggatttaactaaactgaaaacattaactgtgatgtttgtagatgaacggaaaacaatgagtgaaaaattaaagaaaactgaagataaattacaagctgcttcttctcagcttcaagtggagcaaaataaagtaacaacagttactgagaaagttaattgaggaaactaaaagggcgctcaagtcccaaacccgtgttgaagaaaagatgttcgccgttacccaggagagagatgattttaaaaacaaaattgaagccggagaaaagaaagggaatgtctcctgtcaagagttatatgttgg

SEQ ID NO: 418 - DNA, 1218 bp, Homo sapiens
tctgggaagatggcgaaggtctcagagctttacgatgtcacttgggaagaaatgagagataaaatgagaaaatggagagaagaaaactcaagaaatagtgagcaaattgtggaagttggagaagaattaattaatgaatatgcttctaagctgggagatgatatttggatcatatatgaacaggtgatgattgcagcactagactatggtcgggatgacttggcattgttttgtcttcaagagctgagaagacagttccctggcagtcacagagtcaagcgattaacaggcatgagatttgaagccatggaaagatatgatgatgctatacagctatatgataggattttacaagaagatccaactaacactgctgcaagaaagcgtaagattgccattcgaaaagcccaggggaaaaatgtggaggccattcgggagctgaatgagtatctggaacaatttgttggagaccaagaagcctggcatgaacttgcagaactttacatcaatgaacatgactatgcaaaagcagccttttgtttagaggaactaatgatgactaatccacacaaccacttatactgtcagcagtatgctgaagttaagtatacccaaggtggacttgaaaccctcgaactttcaagaaagtttttgcacaggcattgaaactgaacaacagaaatatgagagctttgtttggactttatatgcggcaagtcatattgcttctaatccaaaagcaagtgcaaaaacgaaaaaggcaacatgaaatatgctagttggcagctagtcaaataaacagagcttatcagtttgcaggtcgaagtaagaaggaaaccaaatattctcttaaggctgtcgaagacatgttggaaacattgcagatcacccagtcttaaggtttcaaaaactctttgacattagatttcacaactgcacaattgaacttattggcctgtaacttatttactaaatgctcagtgctatttatatactacagtaattttctgttaagaaggcagttgtaaagaatgtgtttatataaacctaaaaatgccttttactgctaagtggggagatgggggaaatccatggaagagagatttaagacttattgattgtacatcagtctcttcatatcacatatacatgtatatatataaaactctaatgtagtataaccttgttaaataaaccatgatgatttattaaacttgc

SEQ ID NO: 419 - DNA, 810 bp, Homo sapiens
gccgggagttggagcctgcggagttcgagaccatgctgctgttctgccccggctgcgggaacgggctgatcgtggaggagggacaacgctgccaccgcttcgcctgcaacacgtgcccctacgtgcacaacatcacccgcaaggtaacaaatcggaagtacccaaaactgaaagaagtggatgatgtgcttggtggagcagctgcctgggagaatgttgactctactgcagagtcgtgtcccaaatgcgaacatcctcgtgcttacttcatgcagcttcagacccgctctgcagatgagccgatgaccaccttctacaagtgctgcaatgctcagtgtggacaccgctggagggattagggccaggatggcccagctgccctagtgtgtgcttgccttgtccctcggggtagatgcttagctggcagtatgagttgtgtgtcctgagggtctttgctagtgtggtggaaagataaaccttttgaggtgaagagccagggggtcaggaaatatggcctatctgccaggcagggtggatgaagtcatgaatgtctgggagtttttctgtgtggggaggagacagagacccataactaaatatgctctgtgtaaagtcctattctttcatcttccactttattggcagttgacattcccttactcccaatcaacactcttaaatatttgtactgtttgtaaaacttagtacatgtccctaaatatttaactgttacttgtaaacttgtgtaatttattatttattttaatcaaaattctgaatatttcatttaaatgaaagttggaatattgc

SEQ ID NO: 420 - DNA, 1108 bp, Homo sapiens
  misc_feature (23)..(23): n is a, c, g, or t/u
  misc_feature (103)..(103): n is a, c, g, or t/u
  misc_feature (130)..(130): n is a, c, g, or t/u
  misc_feature (180)..(180): n is a, c, g, or t/u
  misc_feature (203)..(203): n is a, c, g, or t/u
  misc_feature (1005)..(1005): n is a, c, g, or t/u
  misc_feature (1014)..(1014): n is a, c, g, or t/u
  misc_feature (1024)..(1024): n is a, c, g, or t/u
  misc_feature (1027)..(1027): n is a, c, g, or t/u
  misc_feature (1057)..(1057): n is a, c, g, or t/u
  misc_feature (1066)..(1066): n is a, c, g, or t/u
  misc_feature (1084)..(1084): n is a, c, g, or t/u
gggggaggaagaggagaaaggcncaggggtgggagctgttgccgaagctgccacagcaaaagttctcccccctccccccttcccctcctctcaaggcccctanaaaggttggagctgccgccgcctgcantcggtgaccgcgcgactcggcgcccgcccgcggatagagggaggaatcancagcttggaaattcaagcacgtnatctggcgggatgggcgtttgcctaacgtatttaatggaggaatcggatggcataagtgattaaggtggtattgaggatttctgaagcctatgaaaggtagaaactcaaccatgatttctttttcaactctacagcattcctttccttgaagtcttcgtttttaccttagtctcgggcagttatacttaagcatgaacattgacgacaaactggaaggattgtttcttaaatgtggcggcatagacgaaatgcagtcttccaggacaatggttgtaatgggtggagtgtctggccagtctactgtgtctggagagctacaggattcagtacttcaagatcgaagtatgcctcaccaggagatccttgctgcagatgaagtgttacaagaaagtgaaatgagacaacaggatatgatatcacatgatgaactcatggtccatgaggagacagtgaaaaatgatgaagagcagatggaaacacatgaaagacttcctcaaggactacagtatgcacttaatgtccctataagcgtaaagcaggaaattacttttactgatgtatctgagcaactgatgagagacaaaaaacaaatcagagagccagtagacttacagaaaaagaagaagcggaaacaacgttctcccgcaaaaatccttacaataaatgaggatggatcacttggtttgaaaacccctaaatctcacgtttgtgagcactgcaatgctgcctttagaacgaactatccttacagagacatgtcttcttcatacaggtgaaaaaccatttcaatgtagtccatgngacatgcgnttcataccanaantacctgctttagagacattgaaaagattcntactggtgnaaaacccttttcccttgngaatgaatgtgggtttgagaattc

SEQ ID NO: 421 - DNA, 680 bp, Homo sapiens
  misc_feature (642)..(642): n is a, c, g, or t/u
  misc_feature (646)..(646): n is a, c, g, or t/u
ggagatctaaaggttgtgattgctgtggggaaaaatcacaacctcaggaaaagtcactcattgggttaaagaatacagaaaataatgacgtagagattagtgaaacaaaaaaggcagatgtgcaagcacctgtaagcccatcagaaacttctcaagctaatccatattctgaaggacaatttttagatgaacatcatagtgtgaattttcatttgggtctcaaagaggataatgatactattaatgattcattaattgtttctgaaaccaaatcaaaagaaaacactatgcaagaatctcttccttctggaatagtaaactttagagaggaaatttgtgatatggattctagtgaagcaatgtctcttgaaagccaggagtcacctaatgaaaattttaaaactgttggcccgtgtttaggagactcgaaaaatgtttcacaggaatctttggagacaaaagaagaaaaaccagaagaaaccccaaaaatggaactgagtctagagaatgttctgttgaaggaaatgcatgtaaagtaacagaatccaatctagagaaagcaaaaactatggaattgaatgtaggaaatgaagctagctttcatggacaagagagaacccaaactggtatttctgaagaacngccnttgaagaaaattaaagaaatggtgactctgaagc

SEQ ID NO: 422 - DNA, 783 bp, Homo sapiens
  misc_feature (122)..(122): n is a, c, g, or t/u
  misc_feature (652)..(652): n is a, c, g, or t/u
  misc_feature (662)..(662): n is a, c, g, or t/u
  misc_feature (698)..(698): n is a, c, g, or t/u
  misc_feature (701)..(701): n is a, c, g, or t/u
  misc_feature (705)..(705): n is a, c, g, or t/u
  misc_feature (712)..(712): n is a, c, g, or t/u
  misc_feature (739)..(739): n is a, c, g, or t/u
  misc_feature (751)..(751): n is a, c, g, or t/u
  misc_feature (758)..(758): n is a, c, g, or t/u
  misc_feature (776)..(776): n is a, c, g, or t/u
gatatttcagtatttaatatatacaaaatgtttctattgaacagaaccaaggtattcacaataagctgcagaaaaacccatgcaattaacaaagaatgaaatttataaattaaaaacattgncgtctatacataatgtacaatcatgcatttaaaaatgaatactatacgtctcataagaataaattttcagtcaactgctgctgcatgaatatttgctaatgcaaatgaataaaatcttagtaaattctgcattaatattttaaccgccagaagttgaaacttttctcatttttcttgaaagctgtccaaagttgacatatgcaggaaaaattcaaattctttcgcatttcatttgaggtttttaaccagtaacaaacttcctaaacctcagtcccaacaaacatgaattaaacaaacaaacaaacaaaaatataaacacctttatcagttcagcaaaaattcaaataaaaatgttcaattttacttaaagtattttacatgtttcaccagaatatgcacgggtttaagaaagcatgaaataaaatgtaagttctgttactagttttgctttcacatctcagtaaagataattaaatttcctgaaaaaccacgcatagcagccaagaatacatattatgaaaaaaaaaaangatcttactnatggacttacacattgaacttacataataatcctgnccntcangggttgnaatgtatcacctttgcaagagctcttnttgaaatggctntattcanaactggttccccatcaanaaatccg

SEQ ID NO: 423 - DNA, 767 bp, Homo sapiens
  misc_feature (472)..(472): n is a, c, g, or t/u
  misc_feature (494)..(494): n is a, c, g, or t/u
  misc_feature (570)..(570): n is a, c, g, or t/u
  misc_feature (606)..(606): n is a, c, g, or t/u
  misc_feature (634)..(634): n is a, c, g, or t/u
  misc_feature (640)..(640): n is a, c, g, or t/u
  misc_feature (652)..(652): n is a, c, g, or t/u
  misc_feature (655)..(655): n is a, c, g, or t/u
  misc_feature (679)..(679): n is a, c, g, or t/u
  misc_feature (722)..(722): n is a, c, g, or t/u
  misc_feature (727)..(727): n is a, c, g, or t/u
  misc_feature (732)..(732): n is a, c, g, or t/u
  misc_feature (754)..(754): n is a, c, g, or t/u
cctttctgaacctgagaggtgacatcgggtctcactggctgcagtttaagctcttgacagaaatctcctccgctgtgtttatattgactgacaatatcagtaagaaggaatacaaattgctgtactccatgaaggagtcaaccacaaaatactacttcatcctgagtccctaccgtgggaagcgcaacacaaacctgagatttctgaataagttaattcctgtgctgaaaatagaccactcacatgtcctggtaaaggtcagcagcactgacagcgacagcttcgtgaagaggatccgggccatcgttgggaatgtgctgcgggcaccctgcaggcgggtatctgtggaggacatggcgcacgcagcccgcaaactgggcctaaaggtcgacgaggactgtgaggagtgtcagaaagcgaaagaccggatggagaggattaccaggaaaatcaaagactcggatgcctacanaaaggaccagctgaggctgcanggggacccctggagaaaggcagcccaagtggagaaggagttctgcaacttcagtgggccgtggcccccctgagaancacaaggctgactgaggcggcgggtgcttgaacttntaatgcacaaaaccggcatgatcctctncggggngcaggagttatntcngggataacaaccctcctgagtganacaatcttctgaggggattgatgggccttgcaccggtggccancccanttaanaacctcggaaccttttaccttnacaaacacggggg

SEQ ID NO: 424 - DNA, 777 bp, Homo sapiens
  misc_feature (155)..(155): n is a, c, g, or t/u
  misc_feature (202)..(202): n is a, c, g, or t/u
  misc_feature (373)..(373): n is a, c, g, or t/u
  misc_feature (449)..(449): n is a, c, g, or t/u
  misc_feature (457)..(457): n is a, c, g, or t/u
  misc_feature (498)..(498): n is a, c, g, or t/u
  misc_feature (502)..(502): n is a, c, g, or t/u
  misc_feature (522)..(522): n is a, c, g, or t/u
  misc_feature (539)..(539): n is a, c, g, or t/u
  misc_feature (576)..(576): n is a, c, g, or t/u
  misc_feature (587)..(587): n is a, c, g, or t/u
  misc_feature (605)..(605): n is a, c, g, or t/u
  misc_feature (608)..(608): n is a, c, g, or t/u
  misc_feature (613)..(613): n is a, c, g, or t/u
  misc_feature (615)..(615): n is a, c, g, or t/u
  misc_feature (625)..(625): n is a, c, g, or t/u
  misc_feature (660)..(660): n is a, c, g, or t/u
  misc_feature (674)..(674): n is a, c, g, or t/u
  misc_feature (714)..(714): n is a, c, g, or t/u
  misc_feature (728)..(728): n is a, c, g, or t/u
  misc_feature (731)..(731): n is a, c, g, or t/u
  misc_feature (748)..(748): n is a, c, g, or t/u
  misc_feature (770)..(770): n is a, c, g, or t/u
catttaacagacatttattaagcgtctacaatgtgccaggccctggggacacagagctggagaatgtacagtccctgccctcaaggagctcacagtctggggggacagacatgtaaacacatgagttacaacgcgctgcgtgaagtgtgtggcanaggtataacaaagtgctgtggggcacaacagagcgaccagtgaactnttcctgggcaggggtcagggaagccttcacagatcagtcaataaatacggtgccatgggagtgccttgcacaccacgggcactcacatcttgaatgctggtccactggaggcccttgggttgggcgggagcaaggcctacttctgcttcctcaggacaacttccccacctntgtcctgggaccacctgcccgcctgggcctgcagtgactaaggacgctgctcccactccaggggccagtgacaganagcagctntacagagggcccaccccgcaggatccttgacaggagctganacanaacaaactgctgcttgtctncctaccctgggggctgngatattcttggtaacatcttttaaactggtctgtgangtcactttctntttttaacacttgttganganaactncnaaacctttgncttttgctcggcttctcatgtcgaatgggcaccanccatttttaaggcnccaaaacacaagccccacatgggtgccccatttaaaaaangggttggccacaanaanaccttcttaaaccttgnaactggggtttttttggacaanttaaaag

SEQ ID NO: 425 - DNA, 771 bp, Homo sapiens
  misc_feature (546)..(546): n is a, c, g, or t/u
  misc_feature (572)..(572): n is a, c, g, or t/u
  misc_feature (584)..(584): n is a, c, g, or t/u
  misc_feature (614)..(614): n is a, c, g, or t/u
  misc_feature (619)..(619): n is a, c, g, or t/u
  misc_feature (629)..(629): n is a, c, g, or t/u
  misc_feature (648)..(648): n is a, c, g, or t/u
  misc_feature (655)..(655): n is a, c, g, or t/u
  misc_feature (667)..(668): n is a, c, g, or t/u
  misc_feature (680)..(680): n is a, c, g, or t/u
  misc_feature (697)..(697): n is a, c, g, or t/u
  misc_feature (706)..(706): n is a, c, g, or t/u
  misc_feature (742)..(742): n is a, c, g, or t/u
  misc_feature (748)..(748): n is a, c, g, or t/u
gggtcccctggtctcgctcccccgcagatcttgcatctcagcatgcgcctaccacatcagttgacattagcacagcttttccattaggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtacaaggtccgtggtcctgtcagtggaaaccccgatagcatgaatgcctctngacttaccacctgggcagcttatgtntaacccttcacnggctcaacaacttccttaccaccaaaaaantgaanaactggtggnttgagcacttaaccctgcnccttctngaaaatgccttnnaggcacttgganggacaagaccaaagttnaccggcctnacttgacttgttcaaaatggaaaaaaaaacaaactncttgancagcctcttatgtgggggactta

SEQ ID NO: 426 - DNA, 737 bp, Homo sapiens
  misc_feature (568)..(568): n is a, c, g, or t/u
  misc_feature (570)..(570): n is a, c, g, or t/u
  misc_feature (591)..(591): n is a, c, g, or t/u
  misc_feature (615)..(615): n is a, c, g, or t/u
  misc_feature (638)..(638): n is a, c, g, or t/u
  misc_feature (684)..(684): n is a, c, g, or t/u
  misc_feature (694)..(694): n is a, c, g, or t/u
  misc_feature (713)..(713): n is a, c, g, or t/u
cgcggcccgccgcccccgcctcaggtgaaatgacaatggatgctctgttggctcgattgaaacttctgaatccagatgaccttagagaagaaatcgtcaaagccggattgaaatgtggacccattacatcaactacaaggttcatttttgagaaaaaattggctcaggctttactggagcaaggaggaaggctgtcttctttctaccaccatgaggcaggtgtcacagctctcagccaggacccacaaaggattttgaagccagctgaagggaacccaactgatcaggctggtttttctgaagacagagattttggttacagtgtgggcctgaatcctccagaggaggaagctgtgacatccaagacctgctcggtgccccctagtgacaccgacacctacagagctggagcgactgcgtctaaggagccgccctgtctatggggtgtgtccagtgtatgaggacgtcccagcgagaaatgaaaggatctatgtttatgaaaataaaaaggaagcatttgcaagctgtcaagatgatcaaagggtccgatttaaagctttttctccananaaaacgctgaaaaatttgctnaaagaatttgtgaatatttccttntccaacaaaacgtctttacactntttctgtgaaaacaacttcactcttttcaatgacaagttgaaaaangttggcttgncgaataaaacagcaccaanagccagcgacagttccaaaatccc

SEQ ID NO: 427 - DNA, 660 bp, Homo sapiens
  misc_feature (115)..(115): n is a, c, g, or t/u
  misc_feature (148)..(148): n is a, c, g, or t/u
  misc_feature (180)..(180): n is a, c, g, or t/u
  misc_feature (287)..(287): n is a, c, g, or t/u
  misc_feature (564)..(564): n is a, c, g, or t/u
  misc_feature (591)..(591): n is a, c, g, or t/u
  misc_feature (611)..(611): n is a, c, g, or t/u
  misc_feature (646)..(646): n is a, c, g, or t/u
agggccaaaacgttttactttccatttgaatttacaaccatatacagacaatatggtaagattttagagaaaacagatcatcactacgaatatccatattctgatttcttttganaaccaaggtgccttttaaaatgcggctttttanaatagcatgtgttgtttctgtctgggatctanatcttgtctgctacaaaacaaatgaacacaccctgtgtaacaaaatcgaattttaacatttaaatcttgattccaatattcctgacctatctcttgtcatatgaaanaaagaagcctttttttaaaacaaagtttcaattcagaatttttacaaacaaaaacaatcctgcgtctacttaatatccctgtatatcctcaaaaagcaagttcaggaaatttaaaaatgatttataaaaggcactgaagttagcaaaagcattggtgggttttcattttggattaaacactggaaatgttcacagagaaacaactgtgtgagcagttgcccgtaacacacaggaagaaaccgacctccaggcagcacctcctgaacacctcagcggntcctccacattccaaccacaaaccttnattcaaagtcaagggggaangcttcaagtcagccccggcaaagaaaccaaaaaangggactcaaaccct

SEQ ID NO: 428 - DNA, 608 bp, Homo sapiens
  misc_feature (562)..(562): n is a, c, g, or t/u
  misc_feature (564)..(564): n is a, c, g, or t/u
  misc_feature (596)..(596): n is a, c, g, or t/u
gtcctcgaggggccttcatgcagctcatcacagtggctgagggcttcagccaggacctgggctgtgaccacatcctggtgatagactccgggggcttgataggtggggccttgacgtcagctggggacagatttgagctggaggcttccttggccactctgctcatgggactgagcaatgtcaccgtgatcagtctagctgaaaccaaggacattccagcagctattctgcatgcatttctgaggttagaaaaaacggggcacatgcccaactaccagtttgtataccagaaccttcatgatgtatctgttcccggccctaggcccagagacaagagacagctcctggatccacctggtgacctgagcagggctgcagcccagatggagaaacagggcgacggcttccgggcactggcaggcctggccttctgcgaccctgagaacaacacatctggcacatccagcctgtggcacggacacctccatggccgcagtgagctttggcctacagtgaaaccatatttgaattgaagagatcctactcgaaaacatcaggaacngnttgtcgaaccaaaacaaaaacattcacaactnattgacttgtga

SEQ ID NO: 429 - DNA, 757 bp, Homo sapiens
  misc_feature (62)..(62): n is a, c, g, or t/u
  misc_feature (135)..(135): n is a, c, g, or t/u
  misc_feature (155)..(155): n is a, c, g, or t/u
  misc_feature (174)..(174): n is a, c, g, or t/u
  misc_feature (186)..(186): n is a, c, g, or t/u
  misc_feature (202)..(202): n is a, c, g, or t/u
  misc_feature (253)..(253): n is a, c, g, or t/u
  misc_feature (345)..(345): n is a, c, g, or t/u
  misc_feature (354)..(354): n is a, c, g, or t/u
  misc_feature (373)..(373): n is a, c, g, or t/u
  misc_feature (447)..(447): n is a, c, g, or t/u
  misc_feature (498)..(498): n is a, c, g, or t/u
  misc_feature (502)..(502): n is a, c, g, or t/u
  misc_feature (539)..(539): n is a, c, g, or t/u
  misc_feature (584)..(584): n is a, c, g, or t/u
  misc_feature (587)..(587): n is a, c, g, or t/u
  misc_feature (671)..(671): n is a, c, g, or t/u
  misc_feature (676)..(676): n is a, c, g, or t/u
  misc_feature (682)..(682): n is a, c, g, or t/u
  misc_feature (704)..(704): n is a, c, g, or t/u
  misc_feature (725)..(725): n is a, c, g, or t/u
catttaacagacatttattaagcgtctacaatgtgccaggccctggggacacagagctgganaatgtacagtccctgccctcaaggagctcacagtctggggggacagacatgtaaacacatgagttacaacgcnctgcgtgaagtgtgtggcanaggtataacaaagtgctgnggggcacaacanagcgaccagtgaactnttcctgggcaggggtcagggaagccttcacagatcagtcaataaatacggngccatgggagtgccttgcacaccacgggcactcacatcttgaatgctggtccactggaggcccttgggttgggcgggagcaaggcctacttntgcttcctnaggacaacttccccacctntgtcctgggaccacctgcccgcctgggcctgcagtgactaaggacgctgctcccactccaggggccagtgacanagagcagctatacagagggcccaccccgcaggatccttgacaggagctganacanaacaaactgctgcttgtctccctaccctgggggctgngatattcttggtaacatctctgaagctggtctgtgaggtcacttnctnttttaaacactgtttgaggagactccaaaccctctgtcttttgctcgtcttctcatgtcgaattggggcaccagcccttttttnaggcnccaaanacacaacccccccattgggtgnccccattaaaaaaggggttgnccacaaaaaaccttcttaaaccttgaactggg

SEQ ID NO: 430 - DNA, 757 bp, Homo sapiens
  misc_feature (7)..(7): n is a, c, g, or t/u
  misc_feature (39)..(39): n is a, c, g, or t/u
  misc_feature (530)..(530): n is a, c, g, or t/u
  misc_feature (558)..(558): n is a, c, g, or t/u
  misc_feature (618)..(618): n is a, c, g, or t/u
  misc_feature (641)..(641): n is a, c, g, or t/u
  misc_feature (650)..(650): n is a, c, g, or t/u
  misc_feature (652)..(652): n is a, c, g, or t/u
  misc_feature (682)..(682): n is a, c, g, or t/u
  misc_feature (688)..(688): n is a, c, g, or t/u
  misc_feature (702)..(702): n is a, c, g, or t/u
  misc_feature (705)..(705): n is a, c, g, or t/u
  misc_feature (721)..(721): n is a, c, g, or t/u
  misc_feature (727)..(727): n is a, c, g, or t/u
cgccgcntgcggtcgtcttatggatccaaagaattcggncgagagagcaggaaaatggactcattagggaggcaggcagtcattaccactcacactgtacttccagggagacaccgattataagaagagaaactcagcgctggggaagaagacaaataaaaagaagtgttaagaattgcctttgggactctgaaggctgaagaattgatgaattgcaagtttgtgccccatagctgcacagactgcctgaagttacatttagagactgaaatcactgcaccttaaaaacaaaagattgagctgcactgtattcctaatgtttcatcattactaacaggatattcctcatgacattgctgtctgatctttgaccatcagtctgtgacctgccccttctctttacatgcagccgctctctgctccctgcccaatgaacatctgcactaggcccaagccttggagtaatttacctgaagagtgcaccattgattttgaaactactgaagaaacccaagacagctgaaaaccanaaggctctgaggagaatgagattactcncccggtggatccagcgccaaccgggccttcctgctgaactttgaactgtttgtttcaganccacccttattcctcacacattnactgacaantntacgctcaaccgggtatttgatgtgaatcnttgcangggatgaccacgcnttncagattaaccttcaantttaanaattcggctcgaaccttaaacaggcaaccg

SEQ ID NO: 431 - DNA, 719 bp, Homo sapiens
  misc_feature (323)..(323): n is a, c, g, or t/u
  misc_feature (547)..(547): n is a, c, g, or t/u
  misc_feature (578)..(578): n is a, c, g, or t/u
  misc_feature (586)..(586): n is a, c, g, or t/u
  misc_feature (588)..(588): n is a, c, g, or t/u
  misc_feature (610)..(610): n is a, c, g, or t/u
  misc_feature (618)..(618): n is a, c, g, or t/u
  misc_feature (621)..(621): n is a, c, g, or t/u
  misc_feature (631)..(631): n is a, c, g, or t/u
  misc_feature (643)..(643): n is a, c, g, or t/u
  misc_feature (656)..(656): n is a, c, g, or t/u
  misc_feature (673)..(673): n is a, c, g, or t/u
  misc_feature (675)..(675): n is a, c, g, or t/u
  misc_feature (703)..(703): n is a, c, g, or t/u
  misc_feature (707)..(707): n is a, c, g, or t/u
aaaagatttttttgtaaagaagggttgtatttagaggccagtagctagagatccaaccagtggacctcttgaagcactaccaggccttaaggccaccatccgagggagactgggaaaactattattcacccaagcctccggaaatgtaatgtaccagcaggcaaaaaacagttcttcatgtagtacaaaatgaaacgaaacaaaaacaaaaacagaaagtaaaaatgaaaccaaaacatttcttaaattctagtgccatagcttttttgtttgtttgttttttgttgttgttttgttttgttcataagaaagagagaaagatnctacttatccgtcagacacatgcatcctcatgtggtcgttgaactgctcgatttggtcaaactttgctgggcagacggagcagacgtaagtggtcccctccgtgcaggccaccacgcctggggggccagcgcgggcacctgggggtgtgcctgcagggggggtcccattgctggcactgtgcaaggccacgtgtcgctccaagaaggtcttgtgagaaaacttnttttttgcaatgtagcactcgtagggacttntcttcccngnggaagcgcatgtgcacgttgangggacctnttntggggggaancacttgttgcanaaactacactggnattgccctcactcctgngnggggtcacccatgtgctttgataaaggnaatnccttttaagggg

SEQ ID NO: 432 - DNA, 789 bp, Homo sapiens
  misc_feature (509)..(509): n is a, c, g, or t/u
  misc_feature (596)..(596): n is a, c, g, or t/u
  misc_feature (616)..(616): n is a, c, g, or t/u
  misc_feature (667)..(667): n is a, c, g, or t/u
  misc_feature (669)..(669): n is a, c, g, or t/u
  misc_feature (676)..(676): n is a, c, g, or t/u
  misc_feature (684)..(684): n is a, c, g, or t/u
  misc_feature (686)..(686): n is a, c, g, or t/u
  misc_feature (707)..(707): n is a, c, g, or t/u
caaagtggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggnttatttgtttgataaaaagtaaaactgtatatgaagggcatttgcttccagaagttatctgattggtaaattatattgtcaggacancaaatacagcttccattatnaactgcgtaaaggtgggctgaacactgcactatgtgtctggactaaaaaanantatacangctctttnanggacaaagggacaatggtaanctttttaaatttatgctacttaccaaaatgaaaacatttgtctcacttccacccctgaagcttaattgggtttttacaaaac

SEQ ID NO: 433 - DNA, 734 bp, Homo sapiens
  misc_feature (175)..(175): n is a, c, g, or t/u
  misc_feature (612)..(612): n is a, c, g, or t/u
  misc_feature (618)..(618): n is a, c, g, or t/u
  misc_feature (620)..(620): n is a, c, g, or t/u
  misc_feature (625)..(625): n is a, c, g, or t/u
  misc_feature (639)..(639): n is a, c, g, or t/u
  misc_feature (670)..(670): n is a, c, g, or t/u
  misc_feature (694)..(694): n is a, c, g, or t/u
  misc_feature (700)..(700): n is a, c, g, or t/u
  misc_feature (702)..(702): n is a, c, g, or t/u
  misc_feature (714)..(714): n is a, c, g, or t/u
aatttaaaaaccatttaatacacaaagtgaaaaactattagaatataaaagcatttcacattttttaagacaaataatatcttctaaattacttagcagatgatagaggtccacagtcctttctctgaaacccttggggcaagttgtttcagaattatgaaattttagattttanaaaagtagttttgtgcatataccatactacattaaccagccctcaccacagtctgtggcagcagccctccctctcatcatcaagcagcaaaataaaggaatattcacactaaatgggataaaaagattcaaggtcagttcagattagattgcaagcaaatgaattttgtcaccaagcttatggaaaccttgttttcagagctttttggattttggaattacaattacagataaaggagtgcagacctttataaatttgtatgacaagacatgaaagattgtttaaacaaatgactcatttttacaaatgaaaaaacatgtaattttcaaatacattataaattaacaggcatcttctctttgatattattaaatgtcatcttaaatacatatacacacaacaacatgatttatgaaagccaacttatattagaagcncagatncncaatnccttcgatgagaanggggatactggtaaattttcagtgggatttnaaaatgattaccccaactcccttntgatgncncggaagaaaaancctgttcagtgcaaccccaa

SEQ ID NO: 434 - DNA, 665 bp, Homo sapiens
  misc_feature (623)..(623): n is a, c, g, or t/u
  misc_feature (650)..(650): n is a, c, g, or t/u
aagaaatagtggagcctgagctctcgatagaagtatgtgaagaaaaagcttcagctgttcttccccctacctgtatacagcttcttgacagcagtaactggaaagaaaggctggcttgtatggaagagttccagaaggctgttgagctaatggaccgaactgaaatgccatgccaggcattagtgaggatgctagccaagaaacctggatggaaagaaactaattttcaggtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacaggttgtgtcaatggctttctcacaaaagaatcccaaaaatcagtcagaaactctgaattggctatcaaatgccataaaagaatttggtttttctgggttgaatgtcaaagctttcattaacaatgtgaagacagctcttgctgcaacaaacccagctgtgaggactgctgccataaccctgcttggcgtgatgtatctgtatgttggnccctcttttgccaaatggtcttttganggatgaaaaaccctg

SEQ ID NO: 435 - DNA, 785 bp, Homo sapiens
  misc_feature (756)..(756): n is a, c, g, or t/u
acacttacctggtacccccccgggtggaaaatcgatgggcccgcggccgctctagaagtactctcgagcatgctcatatccttttcagaaagatttccaatcagtttgaacacctgatccccatgtacattgtacaccgttacaatggtgttgagtgcagcattgcgtacagcattgtcacggtctcctatgtgaacagctatttcctttaaggcttttcctggggttggttggcaaacattcatgccataggactcaaccagacatcccagctcttccaggcactctgctctctgcttagagtttttggatttggttccttccatgataaagggaaacatcttgctagctgggtagacaaggcacatccggttcaggatggcacgaacatctttacgaatgacatcctttggttctccaaccttgacgacaagataggggatgaaggaagatgcttcattctcagtaagatgatattcttcttcacttagcaaggtgaagagcaattttaaatattctagtgctttcatcaggacgcttgtattggtgtcaaaaaacctcagggtaagccactttaagataagatccaggcaaccaataactccttctttttcactctccaagtgatcaaccataacagcaagggctttgttatgatgctgaaagtctgagtgaaacatctcatcttgtaaccatttagccacacagctagacatttgagtctttagttgctcaatggattcatccccgtggggnagtaaaattccctttagcaccttcaatcc

SEQ ID NO: 436 - DNA, 717 bp, Homo sapiens
  misc_feature (258)..(258): n is a, c, g, or t/u
  misc_feature (280)..(280): n is a, c, g, or t/u
atgttttatcatatttaggttatttattaatgaaaatatatgacattttcaggaatacaaattttgcaccctgatgacctcaaatgcgtgcaacaagatgtttaatacagaaaataacacaaaaactgttgttacagtggttagaatttttaactttaaaaaaccatgaatttgtattgttttaattgcacaataaaataatgttgatatatacttaagcttaaattaattccaacaggcaaacattttccaacccanagtgtggctgatgctgggtcanctgactctattttggttcacaccaactttgatgtctaggctattcagcatctacctagaaaatctcaatcgttccaagcataccgtgaattttgtgatttctcagaagattttcggagttaaaagaagtgtttatatcacttaatatccaacatttctaaaggggggaaaaccccccatctattatcaatgacatttcccaagtccttgcaccaggcccttagtcaccaggttcccacgttttgttgctttcctaccgtctcaaaccaggttcatgaaagcatttgaacagagttcagtcttcattttacaaaaaaaaaaaattcctaatagtggctaaaatctgcaaatttctccattcgattacaatctacaaagataaaccagcattcccttctctttctctcttttgggtacttttcccctatccctactggg

SEQ ID NO: 437 - DNA, 709 bp, Homo sapiens
  misc_feature (550)..(550): n is a, c, g, or t/u
  misc_feature (629)..(629): n is a, c, g, or t/u
  misc_feature (660)..(660): n is a, c, g, or t/u
  misc_feature (664)..(664): n is a, c, g, or t/u
ctgaagagtgcagctgcctgaaccgagccctgccgaacagctgagaattgcactgcaaccatgagtgagaacaataagaattccttggagagcagcctacggcaactaaaatgccatttcacctggaacttgatggagggagaaaactccttggatgattttgaagacaaagtattttaccggactgagtttcagaatcgtgaattcaaagccacaatgtgcaacctactggcctatctaaagcacctcaaagggcaaaacgaggcagccctggaatgcttacgtaaagctgaagagttaatccagcaagagcatgctgaccaggcagaaatcagaagtctggtcacctggggaaactatgcctgggtctactatcacatgggccgactctcagacgttcagatttatgtagacaaggtgaaacatgtctgtgagaagttttccagtccctatagaattgagagtccagagcttgactgtgaggaagggtggacacggttaaagtgtggaggaaaccaaaatgaaagagcgaaggtgtgcttttgagaangctctggaaaagaagccaaagaacccagaattcacctcttggactggcaattaccaagctcccgtctggacaactgggnccccattcttaagaacgccatttgacccttntganggcaaagcccattcggctggaattcctgacaacccagtaaccctt

SEQ ID NO: 438 - DNA, 634 bp, Homo sapiens
  misc_feature (537)..(537): n is a, c, g, or t/u
  misc_feature (542)..(542): n is a, c, g, or t/u
  misc_feature (567)..(567): n is a, c, g, or t/u
  misc_feature (587)..(587): n is a, c, g, or t/u
gccgccgccgctaccaccgcgttcgggtgtagaatttggaatccctgcgccgcgttaacaatgaagcagagttcgaacgtgccggctttcctcagcaagctgtggacgcttgtggaggaaacccacactaacgagttcatcacctggagccagaatggccaaagttttctggtcttggatgagcaacgatttgcaaaagaaattcttcccaaatatttcaagcacaataatatggcaagctttgtgaggcaactgaatatgtatggtttccgtaaagtagtacatatcgactctggaattgtaaagcaagaaagagatggtcctgtagaatttcagcatccttacttcaaacaaggacaggatgacttgttggagaacattaaaaggaaggtttcatcttcaaaaccagaagaaaataaaattcgtcaggaagatttaacaaaaattataagtagtgctcagaaggttcagataaaacaggaaactattgagtccaggctttctgaattaaaaagtgagaatgagtccctttggaangaggngtcagaattccagcaaaagcatgcncaacagcaacaagttattcnaaagaatgtcagtttattggtacattggttcaaaataacccaacttt

SEQ ID NO: 439 - DNA, 733 bp, Homo sapiens
actcaacattcattgtatttattttactaaacagtatggttcaaaaaaacacaaaccggaaaacctttatttaaaactagtccaactaactggatggggctcactccatcccatcccacccccgatctttctatatatatggagctggaaccctatcagacagcgagcattcacgtacactttgtctttcctgttgaacatgaataaacgtctttgaacataaatgaacttctctgaaccaaaagaaacaaatgaagttttacaagatacaggcactttatgttcccagttttaaaaataagccaagtgaaaaatatttaataaaaataactggagcagagaaagctttaggagttataccattagttcaaatgacttacactcaatgcaaatagacagcatcaaacaggaaaacaaacaaaaatttaactgaggttaatggtcgtatttgtaaaaaaaagatatccaatttaccaaaattggagaaaaatggccatttgaatccaacttaaagatacgccaataatgtgcattacatctgcgtaactatgcagctgagtaacacctgaaagctctgcaagagtgtgtggttagtgagaaaagcaaaaggtgcttttattccacagtatctgattaaacaaaacaaagcaatttacaaaaaaagtaccaaatgatactttaaaataaatagttcatcattttgatgaatatatacatgtaaaggccactttct

SEQ ID NO: 440 - DNA, 695 bp, Homo sapiens
  misc_feature (589)..(589): n is a, c, g, or t/u
  misc_feature (621)..(621): n is a, c, g, or t/u
  misc_feature (652)..(652): n is a, c, g, or t/u
  misc_feature (659)..(659): n is a, c, g, or t/u
ggcggcaggacctgtacagtgcccgggacctgcagggcctcaccgtggagcatgccattgattccttccgagaaggggagacaatgattcttaccctcaaggacaaaggcgtgctgcaggaggaggaggacgtgctggtgaacgtgaacctggtggataaggagcgggcagagaaaaatgtggagctgcggaagaagaagcctgactacctgccctatgccgaggacgagagcgtggacgacctggcgcagcaaaaacctcgctctatcctgtccaagtatgacgaagagcttgaaggggagcggccacattccttccgcttggagcagggcggcacggctgatggcctgcgggagcgggagctggaggagatccgggccaagctgcggctgcaggctcagtccctgagcacagtggggccccggctggcctccgaatacctcacgcctgaggagatggtgacctttaaaaagaccaagcggagggtgaagaaaatccgcaagaaggagaaggaggtagtagtgcgggcagatgacttgctgcctctcggggaccagactcaggatggggactttggtttcaaactgcngggaacggggtcgccgcccaagtgtccgaaantggaagaagaagaaagaacctttgccttaancccctgncgtcggacgacaccccgaagtggaagaacattggac

SEQ ID NO: 441 - DNA, 623 bp, Homo sapiens
  misc_feature (23)..(23): n is a, c, g, or t/u
  misc_feature (103)..(103): n is a, c, g, or t/u
  misc_feature (130)..(130): n is a, c, g, or t/u
  misc_feature (180)..(180): n is a, c, g, or t/u
  misc_feature (203)..(203): n is a, c, g, or t/u
  misc_feature (447)..(447): n is a, c, g, or t/u
  misc_feature (450)..(450): n is a, c, g, or t/u
  misc_feature (477)..(477): n is a, c, g, or t/u
  misc_feature (495)..(495): n is a, c, g, or t/u
  misc_feature (500)..(500): n is a, c, g, or t/u
  misc_feature (512)..(512): n is a, c, g, or t/u
  misc_feature (532)..(533): n is a, c, g, or t/u
  misc_feature (539)..(539): n is a, c, g, or t/u
  misc_feature (549)..(549): n is a, c, g, or t/u
  misc_feature (551)..(552): n is a, c, g, or t/u
  misc_feature (559)..(559): n is a, c, g, or t/u
  misc_feature (563)..(563): n is a, c, g, or t/u
  misc_feature (579)..(579): n is a, c, g, or t/u
gggggaggaagaggagaaaggcncaggggtgggagctgttgccgaagctgccacagcaaaagttctcccccctccccccttcccctcctctcaaggcccctanaaaggttggagctgccgccgcctgcantcggtgaccgcgcgactcggcgcccgcccgcggatagagggaggaatcancagcttggaaattcaagcacgtnatctggcgggatgggcgtttgcctaacgtatttaatggaggaatcggatggcataagtgattaaggtggtattgaggatttctgaagcctatgaaaggtagaaactcaaccatgatttctttttcaactctacagcattcctttccttgaagtcttcgtttttaccttagtctcgggcagttatacttaagcatgaacattgacgacaaactggaaggattgtttcttaaatgtggcggcatanacnaaatgcagtcttccaggacaatggttntaatgggtggagtgtctngcccnctactgtgtctnggaaagctaccaggattcannactttnaagatcgaangnntgcctcnccangaagatccttgctgcnaatgaagtgtttacaaagaaaggtgaaatggagacaacacggat

SEQ ID NO: 442 - DNA, 742 bp, Homo sapiens
  misc_feature (532)..(532): n is a, c, g, or t/u
  misc_feature (555)..(555): n is a, c, g, or t/u
  misc_feature (650)..(650): n is a, c, g, or t/u
  misc_feature (692)..(692): n is a, c, g, or t/u
  misc_feature (699)..(699): n is a, c, g, or t/u
aacttggtgtgggtggaatagcaagtttctgatctaaaacaagtaatgcattgcttctataaaggtgacaacatgtaaggcagttcaaagaatgctgactaaccaaacgaaatgcagttattggattatcttgctattcatatcagcttaacttgttattacgcattgctcttaaatctgtacagcactccatttacacagagtaaccccactcttgattaatctgttctaaagtgccagtattatttacacttttttttttttagccaaaagtctggccagttgtggcatcaggtgaagatgtcatcccagctctattatcatttacattcaccaagggaaattctgaaaattcagcacttgtccctggtccccgaaggttcacctgtccattggcagtgctaaattgagtagctattccagctcttgatccatgatagggagcacggaagggctgttcaaaggagctcatttggtaagcttggtggacaggctgggcctcagctttcttctgagaagtcacttgatccanaaagtcctgtgttgatgtggcanaaacatggtttgtctcatcacctgaaaagggaaatgagtgctgtgaatcaccaactattagtccaaagtgggacttatctggagttgttcttagnggaaaattcattcctggatcgaaagctattgatgggcatggnggcatanacctgcttgtctatggaaaaaaaagcctggctggatttgggga

SEQ ID NO: 443 - DNA, 652 bp, Homo sapiens
  misc_feature (497)..(497): n is a, c, g, or t/u
  misc_feature (539)..(539): n is a, c, g, or t/u
  misc_feature (542)..(542): n is a, c, g, or t/u
  misc_feature (552)..(552): n is a, c, g, or t/u
  misc_feature (570)..(570): n is a, c, g, or t/u
  misc_feature (604)..(604): n is a, c, g, or t/u
  misc_feature (626)..(626): n is a, c, g, or t/u
  misc_feature (635)..(635): n is a, c, g, or t/u
  misc_feature (638)..(638): n is a, c, g, or t/u
gtcacttccggcttccttcagtccgctggtcccgagcacgagctgtgaggggattcacttgtgtgcggaactcctcggaaccatggcgtccctttcccttgcacctgttaacatctttaaggcaggagctgatgaagagagagcagagacagctcgtctgacttcttttattggtgccatcgccattggagacttggtaaagagcaccttgggacccaaaggcatggacaaaattcttctaagcagtggacgagatgcctctcttatggtaaccaatgatggtgccactattctaaaaaacattggtgttgacaatccagcagctaaagttttagttgatatgtcaagggttcaagatgatgaagttggtgatggcactacctctgttaccgttttagcagcagaattattaagggaagcagaatctttaattgcaaaaaagattcatccacagaccatcatagcgggttggagagaagccacgaaggctgcaaganaggcgctgttgagttctgcagttgatcatgggtcccatgaanttnaattccggcnagaattaatgaatattgngggcccacattatcctcaaaacttcttactcatnacaaaaaccactttacaaaagntagctgtanaancagttctcaaactg

SEQ ID NO: 444 - DNA, 740 bp, Homo sapiens
  misc_feature (243)..(243): n is a, c, g, or t/u
  misc_feature (594)..(594): n is a, c, g, or t/u
  misc_feature (631)..(631): n is a, c, g, or t/u
  misc_feature (700)..(700): n is a, c, g, or t/u
  misc_feature (720)..(720): n is a, c, g, or t/u
gaacagaatcatattcaatatttatttaaaaagaaaaaagagaagctaaatgtgctggttaattttttgttggcttacttgttggtctgtgatcggtgttgtcaggcagctgcactcccatgctttgtaaaagattggaagcaggtcctgccagtccagcttgggagctataggattccaatatatttgaaaccaggttcaggtctacatctactggtgccataacagattctcccgtaccanaatcttcctcatctgaattgttatcggtagtctgggatacaggttccacttggttcctagtggtgaaacttttgctgatgcaggtgtgtgctagttcctggtccatctgggccatgtatgacttgagattatcaagtgttcctttcagggaagcctcttcgccaggttcgtgtgtttcaaagtccaagtcatcatcactatctaaacattcaaagtcttcatcatccagatcatcagaatctgactcattaggccttggccctaaaatcttatcaaaataattaagaaaagaatctgcatcaaaagtgattggagcctcaaaaggttctcgaggcagctctgctcccttgngggttgagactttggatatgaaagctttcatgctctntgaaacttcagttaaagtcataagtctgctccttctcctccttgggaaacaactcggattcttttttgncaacagctttcttgcaacanctgggtccaactgatctggg

SEQ ID NO: 445 - DNA, 714 bp, Homo sapiens
  misc_feature (615)..(615): n is a, c, g, or t/u
  misc_feature (619)..(619): n is a, c, g, or t/u
  misc_feature (623)..(623): n is a, c, g, or t/u
  misc_feature (664)..(664): n is a, c, g, or t/u
  misc_feature (688)..(688): n is a, c, g, or t/u
  misc_feature (696)..(696): n is a, c, g, or t/u
cggaggtgacccggagtctgctgcagcgctggggcgccagttttaggagaggcgccgacttcgactcttggggccagctggtggaggcgatagacgagtatcagatattagcaagacatctacaaaaggaggcccaagctcaacacaataattctgaattcacagaagaacaaaagaaaaccataggcaaaattgcaacatgcttggaattgcgaagtgcagctttacagtccacacagtctcaagaagaatttaaactggaggacctgaagaagctagaaccaatcctaaagaatattcttacatataataaagaattcccatttgatgttcagcctgtcccattaagaagaattttggcacctggtgaagaagagaatttggaatttgaagaagatgaagaagagggtggtgctggagcagggtctcctgattcttttcctgctagagttcccggtactttattaccaaggttgccatcggaaccaggaatgacattactcactatcagaattgagaaaattggtttgaaagatgctgggcagtgcatcgatccctatattacagttagtgtaaaggatctgaatggcataaacttaactcctgtgccaaganactnctgnggcttcaagaaaaagaaaatacatatgttcattttaatggngggacattggagcttccaaaaacnatgttggnaaaaattaacccaaaagg

SEQ ID NO: 446 - DNA, 700 bp, Homo sapiens
  misc_feature (100)..(100): n is a, c, g, or t/u
  misc_feature (140)..(140): n is a, c, g, or t/u
  misc_feature (148)..(148): n is a, c, g, or t/u
  misc_feature (152)..(152): n is a, c, g, or t/u
  misc_feature (165)..(165): n is a, c, g, or t/u
  misc_feature (240)..(240): n is a, c, g, or t/u
  misc_feature (266)..(266): n is a, c, g, or t/u
  misc_feature (317)..(317): n is a, c, g, or t/u
  misc_feature (359)..(359): n is a, c, g, or t/u
  misc_feature (396)..(396): n is a, c, g, or t/u
  misc_feature (401)..(401): n is a, c, g, or t/u
  misc_feature (413)..(413): n is a, c, g, or t/u
  misc_feature (585)..(585): n is a, c, g, or t/u
  misc_feature (618)..(618): n is a, c, g, or t/u
  misc_feature (681)..(681): n is a, c, g, or t/u
  misc_feature (696)..(696): n is a, c, g, or t/u
cggttttgctacactttaatgggtttttttttaagggattttttttcaggtcttgtcagcaacatcaaacaaaaggtactgagtactccacagggtacanagtgctgccaaacaccttaaaaaaattacatgacacgganaaaatgcncctnttgctccttgaanagcttacagtctagggatttgacaactcacagtcttaggaactgggcaaagtaaggcaaattcttcatcccctanagctattgtggactgaatcattttanaatttggaattaatccaatcaagatgagagacaagactaaatttggctganaattcattcaggctcgcatagtttttattaacatccgtctantaaacagaatggacctaacagacaactgaaagtaaanactanatctcttgaagngcaagggctacaacaacttaattggggttacttattttaaaaagcaaacatactgaatggtatgactagggtgattacactagtttaaaaataggccaggtactgacactgcattcccctcatgcattgctcatttaaaatagtgaatattaaaatatgtgggctttacatntaacccacagaaagcccaccgcaaatgttctgnggtatcaaattccccctctgtgtactatgaaagttttatttatgccccattaagtcaaaagtnaattatagtaagctnatga

SEQ ID NO: 447 - DNA, 641 bp, Homo sapiens
  misc_feature (560)..(560): n is a, c, g, or t/u
  misc_feature (604)..(604): n is a, c, g, or t/u
gcggtagccgcttttcgtcgactcttaccggttggctgggccagctgcgccgcggctcacagctgacgatgggggaccccagcaagcaggacatcttgaccatcttcaagcgcctccgctcggtgcccactaacaaggtgtgttttgattgtggtgccaaaaatcccagctgggcaagcataacctatggagtgttcctttgcattgattgctcagggtcccaccggtcacttggtgttcacttgagttttattcgatctacagagttggattccaactggtcatggtttcagttgcgatgcatgcaagtcggaggaaacgctagtgcatcttccttttttcatcaacatgggtgttccaccaatgacaccaatgccaagtacaacagtcgtgctgctcagctctatagggagaaaatcaaatcgctcgcctctcaagcaacacggaagcatggcactgatctgtggcttgatagttgtgtggttccacctttgtcccctccaccaaaggaggaagatttttttgcctctcacgtttcttctgaggtgagtgacacaacngtgggcatttaacaataaccagaaccatcttttttaacatcaangcctgtgggaaaccactttttggaaaaaaaatgaaag

SEQ ID NO: 448 - DNA, 761 bp, Homo sapiens
  misc_feature (623)..(623): n is a, c, g, or t/u
  misc_feature (661)..(661): n is a, c, g, or t/u
  misc_feature (668)..(668): n is a, c, g, or t/u
ctgctgcaagtgtttattctatttagaagtctacaaatttgagcttttaagaaagattcacaaaatattcattcaaaaccacatttttggcttatcaaatttcaaatatattttactgtgctgaacaatatattctaatgctgtctaaaacacagctaaattatttttctttatttgtttatacacattcggtaatttctgaaaagcaagatttaaaaatatttattaacaaaactacccaattacaatgactgttctcccatacacgcaactattttctgtagctgtatcttcttacctcattccactttaactctgtataccgtattgatttgtgatgagatgatttattatgagaactcttagggagttctcatcttccatttctcatcaattcaaacagcaacacctttcacaagataacattaattcccttggcagggcagaagcttaagtttgttaaaagcactcactgaaaaacatttttaaatttataggtcatataaaataatttacaaagagacagatgacttcaaatattatttggcagtcaccttactatgtagaaacataaatgaagcaatctgtcacacgagacaccagtcacttttggtcttttgaangaagtgtgtgtggtgagtgttgtttctgcaggcccatncagcatnccgctgattctggcagccctgagccctgtggtcacatgggggaccttttcttctccccaatggaagcctctggttcaggaccaggaggagccg

SEQ ID NO: 449 - DNA, 675 bp, Homo sapiens
  misc_feature (58)..(58): n is a, c, g, or t/u
  misc_feature (540)..(540): n is a, c, g, or t/u
  misc_feature (593)..(593): n is a, c, g, or t/u
  misc_feature (600)..(600): n is a, c, g, or t/u
  misc_feature (652)..(652): n is a, c, g, or t/u
  misc_feature (659)..(659): n is a, c, g, or t/u
  misc_feature (664)..(664): n is a, c, g, or t/u
acggcgaggacgtgcgaggggtgctgaagaggcgcgtggagacgaggcagcacactgnggaggcgatccgccagcaggaggtggagcagctggacttccgagacctcctggggaagaaggtgagtacaaagaccctatcggaagacgacctgaaggagatcccagccgagcagatggatttccgtgccaacctgcagcggcaagtgaagccaaagactgtgtctgaggaagagaggaaggtgcacagcccccagcaggtcgattttcgctctgtcctggccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgcccaagcctgctgagaccctgaagccaatggggcaacgccaagcctgncgagaccctgaaaccccatgggcaatgccaagccttgatgagaacctgaaatnccgcttngcaaaagaagaaactcaaagaaaagacgtttaagaaatgatgtggaaacttnaaagaanaaggncatgcccgggg

SEQ ID NO: 450 - DNA, 791 bp, Homo sapiens
  misc_feature (36)..(36): n is a, c, g, or t/u
  misc_feature (283)..(283): n is a, c, g, or t/u
  misc_feature (574)..(574): n is a, c, g, or t/u
  misc_feature (598)..(598): n is a, c, g, or t/u
  misc_feature (633)..(633): n is a, c, g, or t/u
  misc_feature (636)..(636): n is a, c, g, or t/u
  misc_feature (648)..(648): n is a, c, g, or t/u
  misc_feature (663)..(663): n is a, c, g, or t/u
  misc_feature (684)..(684): n is a, c, g, or t/u
  misc_feature (736)..(736): n is a, c, g, or t/u
  misc_feature (760)..(760): n is a, c, g, or t/u
gagttttagagaaatagtccttttaatatgacttanaaactgcttttctctggctttgtttcactcttcttcctcttccccttccccttcaccttcctccatcgtttccacaatgagctctgctgtgcaggtggcttctccaagactgttgacagccttgcaggtgtacttggcatcgtcatccccgcaaacatcactaataattaaagagcagttcccgtcctcatcgtagtctatctggaagtggcgggactccctgattgactggtcatctttgaaccanacaacctcggggtctgggtatccttcaatcttgcagtcaaatctagcagcacttccctccacaacttctaaatcgcgaatggtcttagagaaatagggttttacatgaggcttttcctcagcaacagcctcaaggaaagcttgggacacatcttcagattctagtttttctgcattgagcgggctggttggtgaccctgttgaggatttcctgccactgagccctgagatcattgccatagaggacagtcttccaatggctctcacagcattgcccgttttctgccatttncttcttgccatgtacttcttcatncggccttggaaagtttcttggcctccatgttcttnggnatctttcattanccatggatgctgaangcactgcgtgcagtccaagcnggttttcatatctttcttcagcaaaatgctgatgaaatccttggcatcgtcngagaatctcatcgaatgccctcgnccgtcgaaatcccaagtgggctggaggtaac

SEQ ID NO: 451 - DNA, 726 bp, Homo sapiens
  misc_feature (616)..(616): n is a, c, g, or t/u
  misc_feature (618)..(618): n is a, c, g, or t/u
  misc_feature (705)..(705): n is a, c, g, or t/u
tctgggaagatggcgaaggtctcagagctttacgatgtcacttgggaagaaatgagagataaaatgagaaaatggagagaagaaaactcaagaaatagtgagcaaattgtggaagttggagaagaattaattaatgaatatgcttctaagctgggagatgatatttggatcatatatgaacaggtgatgattgcagcactagactatggtcgggatgacttggcattgttttgtcttcaagagctgagaagacagttccctggcagtcacagagtcaagcgattaacaggcatgagatttgaagccatggaaagatatgatgatgctatacagctatatgataggattttacaagaagatccaactaacactgctgcaagaaagcgtaagattgccattcgaaaagcccaggggaaaaatgtggaggccattcgggagctgaatgagtatctggaacaatttgttggagaccaagaagcctggcatgaacttgcagaactttacatcaatgaacatgactatgcaaaagcagccttttgtttagaggaactaatgatgactaatccacacaaccacttatactgtcagcagtatgctgaagttaagtatacccaangnggacttgaaaacctcgactttcaagaaagtattttgcacaggcattgaaactgacaacagaaatatgagagctttggttggactttntatgtcggcaagtcatattgc

SEQ ID NO: 452 - DNA, 907 bp, Homo sapiens
  misc_feature (543)..(543): n is a, c, g, or t/u
  misc_feature (546)..(546): n is a, c, g, or t/u
  misc_feature (550)..(550): n is a, c, g, or t/u
  misc_feature (577)..(577): n is a, c, g, or t/u
  misc_feature (589)..(589): n is a, c, g, or t/u
  misc_feature (591)..(591): n is a, c, g, or t/u
  misc_feature (599)..(599): n is a, c, g, or t/u
  misc_feature (609)..(609): n is a, c, g, or t/u
  misc_feature (635)..(635): n is a, c, g, or t/u
  misc_feature (639)..(639): n is a, c, g, or t/u
  misc_feature (645)..(645): n is a, c, g, or t/u
  misc_feature (653)..(653): n is a, c, g, or t/u
  misc_feature (660)..(660): n is a, c, g, or t/u
  misc_feature (683)..(683): n is a, c, g, or t/u
  misc_feature (687)..(687): n is a, c, g, or t/u
  misc_feature (689)..(689): n is a, c, g, or t/u
  misc_feature (699)..(699): n is a, c, g, or t/u
  misc_feature (704)..(704): n is a, c, g, or t/u
  misc_feature (709)..(709): n is a, c, g, or t/u
  misc_feature (712)..(712): n is a, c, g, or t/u
  misc_feature (739)..(739): n is a, c, g, or t/u
  misc_feature (747)..(747): n is a, c, g, or t/u
  misc_feature (752)..(752): n is a, c, g, or t/u
  misc_feature (758)..(758): n is a, c, g, or t/u
  misc_feature (797)..(797): n is a, c, g, or t/u
  misc_feature (805)..(805): n is a, c, g, or t/u
  misc_feature (824)..(824): n is a, c, g, or t/u
  misc_feature (831)..(831): n is a, c, g, or t/u
  misc_feature (840)..(840): n is a, c, g, or t/u
  misc_feature (863)..(863): n is a, c, g, or t/u
  misc_feature (866)..(866): n is a, c, g, or t/u
  misc_feature (875)..(875): n is a, c, g, or t/u
  misc_feature (888)..(888): n is a, c, g, or t/u
  misc_feature (900)..(900): n is a, c, g, or t/u
gcaagtttaataaatcatcatggtttatttaacaaggttatactacattagagttttatatatatacatgtatatgtgatatgaagagactgatgtacaatcaataagtcttaaatctctcttccatggatttcccccatctccccacttagcagtaaaaggcatttttaggtttatataaacacattctttacaactgccttcttaacagaaaattactgtagtatataaatagcactgagcatttagtaaataagttacaggccaataagttcaattgtgcagttgtgaaatctaatgtcaaagagtttttgaaaccttaagactgggtgatctgcaatgtttccaacatgtcttcgacagccttaagagaatatttggtttccttcttacttcgacctgcaaactgataagctctgtttatttgactagctgccaactagcatatttcatgttgcctttttcgtttttgcacttgcttttggattagaagcaatatgacttgccgcatataaagtccaaacaaagctctcatatttctgntgntcangtttcaatgcctgtgcaaaaactttcntgaaagttcgangntttcaaanccccttgggnatacttaacttcagcatactgggtgnaagnataagngggtgggnggattantcatcattaggtccccttaaacnaaangngggtttttgnatagncatgntcnattgaagggaaaggtcctgcaagtttnatggccangcttntttggncttccacaaaatggttccaaaacctcattcaactcccgnaaggggcncaaattttttccctggggngttttgnaaggggaantttaccctttttggaaaaaaggnaantgggaactnttgggaaaaaccnttttataagcgnggtaagc

SEQ ID NO: 453 - DNA, 669 bp, Homo sapiens
  misc_feature (544)..(544): n is a, c, g, or t/u
  misc_feature (557)..(557): n is a, c, g, or t/u
  misc_feature (582)..(582): n is a, c, g, or t/u
  misc_feature (622)..(622): n is a, c, g, or t/u
  misc_feature (638)..(638): n is a, c, g, or t/u
  misc_feature (653)..(653): n is a, c, g, or t/u
  misc_feature (659)..(659): n is a, c, g, or t/u
accatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggcccgtggtgtcttccatgggattgaaaatttcatcaatgaagcttcttacatgagcattttangaatgacaccaanggtttggagataaaacatttgttgntcaaggattttggtaatgtgggcctgcactctatgaaaanatttacatcgtttggngctaaatgtattgcntgtggngaagtctgat

SEQ ID NO: 454 - DNA, 593 bp, Homo sapiens
  misc_feature (239)..(239): n is a, c, g, or t/u
  misc_feature (402)..(402): n is a, c, g, or t/u
  misc_feature (448)..(448): n is a, c, g, or t/u
  misc_feature (496)..(496): n is a, c, g, or t/u
  misc_feature (508)..(508): n is a, c, g, or t/u
  misc_feature (516)..(516): n is a, c, g, or t/u
  misc_feature (527)..(527): n is a, c, g, or t/u
  misc_feature (531)..(531): n is a, c, g, or t/u
  misc_feature (534)..(534): n is a, c, g, or t/u
  misc_feature (542)..(542): n is a, c, g, or t/u
  misc_feature (552)..(552): n is a, c, g, or t/u
  misc_feature (559)..(559): n is a, c, g, or t/u
ggaaaacgtagacttttaataactgcttttatcaccaggttaagccatgcagttacaaagtagttagaaatttctgaagggtgttagagttaaaaaaaaaaaaaagctgactcttacacatatattatctagcacttcatggggacactactgttcaaaaggccctggccaaataactcccaaatgaaacactcaacccaaggatgttttcagcccactgttagtgaagctgggtgcanaatgcaaagcctctaaaaggagaggatacaaagtcaggtgagtaggggccattggcaatgctcagagccagccagactccaaacagggagcccaagtggtttttttctgggacactctacttgaattattgtttaattagtcaaccatagatcttcaaaaganaacaattagttaacatgataaaaagtgactggattctttggactgnattataattattgtaagccaattctgacggtttaatgaaaatagcccncccattttgcanggttgaanatacttaattnttcncanggcttttnatggctggtngccatcntggatggatagctttaatggccttggtttatgaa

SEQ ID NO: 455 - DNA, 712 bp, Homo sapiens
  misc_feature (23)..(23): n is a, c, g, or t/u
  misc_feature (31)..(31): n is a, c, g, or t/u
  misc_feature (40)..(41): n is a, c, g, or t/u
  misc_feature (47)..(47): n is a, c, g, or t/u
  misc_feature (60)..(60): n is a, c, g, or t/u
  misc_feature (106)..(106): n is a, c, g, or t/u
  misc_feature (116)..(116): n is a, c, g, or t/u
  misc_feature (126)..(126): n is a, c, g, or t/u
  misc_feature (154)..(154): n is a, c, g, or t/u
  misc_feature (165)..(165): n is a, c, g, or t/u
  misc_feature (172)..(173): n is a, c, g, or t/u
  misc_feature (179)..(179): n is a, c, g, or t/u
  misc_feature (184)..(185): n is a, c, g, or t/u
  misc_feature (201)..(201): n is a, c, g, or t/u
  misc_feature (232)..(232): n is a, c, g, or t/u
  misc_feature (234)..(234): n is a, c, g, or t/u
  misc_feature (237)..(239): n is a, c, g, or t/u
  misc_feature (249)..(249): n is a, c, g, or t/u
  misc_feature (267)..(269): n is a, c, g, or t/u
  misc_feature (275)..(275): n is a, c, g, or t/u
  misc_feature (279)..(279): n is a, c, g, or t/u
  misc_feature (281)..(281): n is a, c, g, or t/u
  misc_feature (286)..(286): n is a, c, g, or t/u
  misc_feature (290)..(290): n is a, c, g, or t/u
  misc_feature (298)..(299): n is a, c, g, or t/u
  misc_feature (312)..(313): n is a, c, g, or t/u
  misc_feature (317)..(317): n is a, c, g, or t/u
  misc_feature (321)..(321): n is a, c, g, or t/u
  misc_feature (323)..(323): n is a, c, g, or t/u
  misc_feature (328)..(328): n is a, c, g, or t/u
  misc_feature (338)..(338): n is a, c, g, or t/u
  misc_feature (348)..(348): n is a, c, g, or t/u
  misc_feature (354)..(354): n is a, c, g, or t/u
  misc_feature (358)..(358): n is a, c, g, or t/u
  misc_feature (361)..(361): n is a, c, g, or t/u
  misc_feature (374)..(374): n is a, c, g, or t/u
  misc_feature (387)..(387): n is a, c, g, or t/u
  misc_feature (458)..(458): n is a, c, g, or t/u
  misc_feature (462)..(462): n is a, c, g, or t/u
  misc_feature (471)..(471): n is a, c, g, or t/u
  misc_feature (505)..(505): n is a, c, g, or t/u
  misc_feature (536)..(536): n is a, c, g, or t/u
  misc_feature (539)..(540): n is a, c, g, or t/u
  misc_feature (576)..(576): n is a, c, g, or t/u
  misc_feature (579)..(580): n is a, c, g, or t/u
  misc_feature (585)..(585): n is a, c, g, or t/u
  misc_feature (600)..(600): n is a, c, g, or t/u
  misc_feature (624)..(624): n is a, c, g, or t/u
  misc_feature (628)..(628): n is a, c, g, or t/u
  misc_feature (634)..(634): n is a, c, g, or t/u
  misc_feature (648)..(648): n is a, c, g, or t/u
  misc_feature (657)..(657): n is a, c, g, or t/u
  misc_feature (663)..(663): n is a, c, g, or t/u
  misc_feature (671)..(671): n is a, c, g, or t/u
  misc_feature (677)..(677): n is a, c, g, or t/u
  misc_feature (682)..(682): n is a, c, g, or t/u
  misc_feature (685)..(685): n is a, c, g, or t/u
  misc_feature (691)..(691): n is a, c, g, or t/u
  misc_feature (700)..(700): n is a, c, g, or t/u
  misc_feature (706)..(706): n is a, c, g, or t/u
ccttactcgcgcgcctgcaggtngacactantaggatccnngaattnggcacgaccaggnattgatgcgccagggatcccaaatttttgggtaacaacatttgcanccatccacanactgtctgcnctgcttggggaggaagatgaatgaggcnctgtttatttnaccatgnnttgaancgacnnaatttgctgatattanatccagttacctaatagatttttatttctgntnaannnccttactttnaaaataaagacctctccnnncaattntatntnattgngagnggtgatcnntcttcgacctccnncganctcnantgganttctgcacangatttgactnaccgtntcantcnccctgcagaatanagccatcaaggangaggcattcatgaggaaccagagagcttctttacctggtttactgaccattctgatgcaggtgctgatganttangagaggtcntcaaagatgatatttggccaaacccattacagtnctacttggttcccgatatggatgatgaaaancgnnaaggagaaagaagatgatgatgatgatgaagagganganngattnaaacatattgactantaatgggatgaggatgaaggtgangaanatgaantatgatgatgaaangggaagaangagagnaagattgncgtaanatttnctntatagnacactgttngattcnaacctt

SEQ ID NO: 456 - DNA, 760 bp, Homo sapiens
  misc_feature (3)..(3): n is a, c, g, or t/u
  misc_feature (9)..(9): n is a, c, g, or t/u
  misc_feature (16)..(16): n is a, c, g, or t/u
  misc_feature (25)..(25): n is a, c, g, or t/u
  misc_feature (29)..(29): n is a, c, g, or t/u
  misc_feature (36)..(36): n is a, c, g, or t/u
  misc_feature (45)..(45): n is a, c, g, or t/u
  misc_feature (61)..(61): n is a, c, g, or t/u
  misc_feature (64)..(64): n is a, c, g, or t/u
  misc_feature (68)..(68): n is a, c, g, or t/u
  misc_feature (74)..(74): n is a, c, g, or t/u
  misc_feature (76)..(76): n is a, c, g, or t/u
  misc_feature (80)..(80): n is a, c, g, or t/u
  misc_feature (85)..(85): n is a, c, g, or t/u
  misc_feature (92)..(92): n is a, c, g, or t/u
  misc_feature (94)..(94): n is a, c, g, or t/u
  misc_feature (97)..(97): n is a, c, g, or t/u
  misc_feature (109)..(109): n is a, c, g, or t/u
  misc_feature (113)..(113): n is a, c, g, or t/u
  misc_feature (115)..(115): n is a, c, g, or t/u
  misc_feature (118)..(118): n is a, c, g, or t/u
  misc_feature (120)..(120): n is a, c, g, or t/u
  misc_feature (124)..(124): n is a, c, g, or t/u
  misc_feature (132)..(132): n is a, c, g, or t/u
  misc_feature (143)..(143): n is a, c, g, or t/u
  misc_feature (145)..(145): n is a, c, g, or t/u
  misc_feature (154)..(154): n is a, c, g, or t/u
  misc_feature (160)..(160): n is a, c, g, or t/u
  misc_feature (184)..(184): n is a, c, g, or t/u
  misc_feature (197)..(197): n is a, c, g, or t/u
  misc_feature (218)..(218): n is a, c, g, or t/u
  misc_feature (220)..(220): n is a, c, g, or t/u
  misc_feature (237)..(237): n is a, c, g, or t/u
  misc_feature (241)..(241): n is a, c, g, or t/u
  misc_feature (260)..(260): n is a, c, g, or t/u
  misc_feature (262)..(262): n is a, c, g, or t/u
  misc_feature (265)..(265): n is a, c, g, or t/u
  misc_feature (275)..(275): n is a, c, g, or t/u
  misc_feature (277)..(277): n is a, c, g, or t/u
  misc_feature (281)..(281): n is a, c, g, or t/u
  misc_feature (308)..(308): n is a, c, g, or t/u
  misc_feature (329)..(329): n is a, c, g, or t/u
  misc_feature (349)..(349): n is a, c, g, or t/u
  misc_feature (351)..(351): n is a, c, g, or t/u
  misc_feature (359)..(359): n is a, c, g, or t/u
  misc_feature (373)..(373): n is a, c, g, or t/u
  misc_feature (375)..(375): n is a, c, g, or t/u
  misc_feature (379)..(379): n is a, c, g, or t/u
  misc_feature (404)..(404): n is a, c, g, or t/u
  misc_feature (450)..(450): n is a, c, g, or t/u
  misc_feature (459)..(459): n is a, c, g, or t/u
  misc_feature (476)..(476): n is a, c, g, or t/u
  misc_feature (503)..(503): n is a, c, g, or t/u
  misc_feature (509)..(509): n is a, c, g, or t/u
  misc_feature (524)..(524): n is a, c, g, or t/u
  misc_feature (539)..(539): n is a, c, g, or t/u
  misc_feature (545)..(545): n is a, c, g, or t/u
  misc_feature (548)..(548): n is a, c, g, or t/u
  misc_feature (554)..(554): n is a, c, g, or t/u
  misc_feature (557)..(557): n is a, c, g, or t/u
  misc_feature (585)..(586): n is a, c, g, or t/u
  misc_feature (593)..(593): n is a, c, g, or t/u
  misc_feature (595)..(595): n is a, c, g, or t/u
  misc_feature (599)..(599): n is a, c, g, or t/u
  misc_feature (605)..(605): n is a, c, g, or t/u
  misc_feature (608)..(609): n is a, c, g, or t/u
  misc_feature (616)..(616): n is a, c, g, or t/u
  misc_feature (649)..(650): n is a, c, g, or t/u
  misc_feature (654)..(654): n is a, c, g, or t/u
  misc_feature (696)..(696): n is a, c, g, or t/u
  misc_feature (714)..(714): n is a, c, g, or t/u
  misc_feature (719)..(719): n is a, c, g, or t/u
  misc_feature (728)..(728): n is a, c, g, or t/u
  misc_feature (731)..(731): n is a, c, g, or t/u
  misc_feature (744)..(744): n is a, c, g, or t/u
  misc_feature (754)..(754): n is a, c, g, or t/u
aancaaganaaagtanacagatccntgtnggtaaangctaactgnccatattcacataaanacncagngtcctntntgancccantttccananaanggaggaaaaaanctananttntntgcnctactacncaggggcctancnccctccagnttccancaaagcgaagggagcaggtttttnttttttcccacanagctcgggggggttgattccntncagtttttgttcaaacnggangggataaaaatgaacttcnancanaaaggggtananactnttttcccattgtattctgctcaaggtntttccccccaaataaattganaaccatggagtaaaaaaaananacctcaanaacagggcgactgncncaanagggaaaaaaaaaaaaaaaaagacngcaacttgctcccagggactggaaaaaatttaaaaaaaggaaggtnggaatccancagggttctatttaggnattttctccttaatcctcctctccttnctcccnttaataataatattnatcttcttcaccttnatcctnatncccttnttngaaaatattttctaaccttcctcctctnnataaatnanaatnaacttnttnnccttctncttcttcatcatccatatcggggacccaaatanncttnaattgggtttgggcccaaaattattttttgtagaccttttcntacttattaaaaacctgntttanaaaggggcngtnaaccagggtaaanaaaccttttnggttcc

SEQ ID NO: 457 - DNA, 811 bp, Homo sapiens
  misc_feature (565)..(565): n is a, c, g, or t/u
  misc_feature (628)..(628): n is a, c, g, or t/u
  misc_feature (630)..(630): n is a, c, g, or t/u
  misc_feature (647)..(647): n is a, c, g, or t/u
  misc_feature (656)..(656): n is a, c, g, or t/u
  misc_feature (664)..(664): n is a, c, g, or t/u
  misc_feature (757)..(757): n is a, c, g, or t/u
  misc_feature (775)..(775): n is a, c, g, or t/u
  misc_feature (797)..(797): n is a, c, g, or t/u
tggcggcgggctcctgcgagaagcaagcggaacttcctgagcgtgcttaggtgtcacagctgggtgaccctccgaaggaaggttttgccgctggcgcgtctggtgtatcgcggccttggggccgcggatccctggggcttgccgctgcctctggggttcgcgcggccctggcgtcggggctgcctcagcgctggctgaaggccggcccgaagcacccttaattgtggccgcgcgcttccctgctgctcctgctgttctccgcgtcgcggtggtggactctggaggtggagccttgcccggcgagacgttgaggaggaatcattatagattctaaaaatatattttcccttctctgtggacttggtataaaacgtagctttttttctgcttggatttattttctaaaaatcaacaccgtaaacccatatcagatacaacaaaattggggtagttaaaaccatgagttgtggaaatgagtttgtggaaacattaaaaaaaattggttatcccaaagctgataatcttaatggagaagactttgactggttgtttgagggcgttgaanatgaatcgtttctgaagtggttttgtgggaatgtgaatgaacagaacgtgttgtcttgaaaananaattggaagcttttaanattctttanaaaatcangcaagcctatttctaaaaaaggggccggcatttggattgaaagctctttaaaaacgtgtaaaaactttcttgatttggaaagaacaccctaanactgggattgaataaaanaaccttggaagaaaatttaganggattgaagggttc

SEQ ID NO: 458 - DNA, 801 bp, Homo sapiens
  misc_feature (636)..(636): n is a, c, g, or t/u
  misc_feature (752)..(752): n is a, c, g, or t/u
aaaaatttagtagtgtttattatacacagtcttctaataaataaaagaggacacgtaataaagattcagttttcagtaattttcaatcttcaagactaacagccttaatctttgattgagtttctaaattctccacaatatctttcagataatcttcatcttttaaaaaatatacatagaattctctttccatttgatgtaatttattatttgccaaagtttttctttttgtcttcacatcagcaagaatatcagtgaggagatgatttagcttattcagttgagattcaactttatgaaactgctctgttaactcctgatcactaagcaaaagctgatttcctccttgatacaaagtatcacaaagcatgtccacatccttattccgtttggacagaaagaaagaatgttcttgagcagatactgccaactgatcttgtactaaagaaatattctgtttcaatttctcagccacttcctcaaggtttccatgagttagaaacaattcttttttcttattctctccctccaaaacttggtaaagcctatgagtagaataatccttagtatcaatggtattccttggatttatctgttgagaaactgatggatctgttaacatttctaattgcttgnaaagcatcatgttactttgactaagttcttgaaccaaattttcaaggttgacgatatatgtccccgagctttcttaattcaatttctatggataaccggggaagttcaaatgatgncctttggtttattaatggatttaaaactaacccttggcttgctggataa

SEQ ID NO: 459 - DNA, 695 bp, Homo sapiens
  misc_feature (595)..(595): n is a, c, g, or t/u
  misc_feature (631)..(631): n is a, c, g, or t/u
ggcggctgtacaactcggccgttgtcaccatgccggtcgtccggaagattttccgtcgccgccggggcgactcggagtcagaggaagatgagcaggactcagaggaggttcgattaaaactggaagagaccagagaagtacagaacttgaggaagaggcccaacggggtgagtgctgtggccttgctggtgggagagaaggtacaagaggagaccactctagtggatgatccctttcagatgaagacaggtggtatggtggatatgaagaaactgaaggaaaggggcaaagataagatcagtgaggaggaggacctgcacctggggacatcgttttctgcagaaaccaaccgaagggatgaggatgcagacatgatgaagtacattgagacagagctaaagaagaggaaagggatcgtggaacatgaggaacagaaagttaagccaaagaatgcagaggactgtctttatgaacttccagaaaacatccgtgtttcctcagcaaagaagaccgaggagatgctttccaaccagatgctgagtggcattcctgaggtggacctgggcatcgatgctaaaataaaaaatatcatttncacggaggatgccaaggcccgtctgctggcagagcnccgaaccaggaagaaagaccgcgagacctctttgtgcctaccaacatggctgtgaattattgtc

SEQ ID NO: 460 - DNA, 780 bp, Homo sapiens
  misc_feature (596)..(596): n is a, c, g, or t/u
  misc_feature (636)..(636): n is a, c, g, or t/u
  misc_feature (682)..(682): n is a, c, g, or t/u
aaaaatttagtagtgtttattatacacagtcttctaataaataaaagaggacacgtaataaagattcagttttcagtaattttcaatcttcaagactaacagccttaatctttgattgagtttctaaattctccacaatatctttcagataatcttcatcttttaaaaaatatacatagaattctctttccatttgatgtaatttattatttgccaaagtttttctttttgtcttcacatcagcaagaatatcagtgaggagatgatttagcttattcagttgagattcaactttatgaaactgctctgttaactcctgatcactaagcaaaagctgatttcctccttgatacaaagtatcacaaagcatgtccacatccttattccgtttggacagaaagaaagaatgttcttgagcagatactgccaactgatcttgtactaaagaaatattctgtttcaatttctcagccacttcctcaaggtttccatgagttagaaacaattcttttttcttattctctccctccaaaacttggtaaagcctatgagtagaataatccttagtatcaatggtattccttggatttatctgntgagaaactgatggatctgttaacatttctaattgcttgnagagcatcatgttactttgactaaggttcttggaaccaaattttcnaggtggccgatatatgtcccgaagcctttcttaaattcaattttcattatggaataacctgggagaaagtccaaatggatgcccctttggggtttatt

SEQ ID NO: 461 - DNA, 753 bp, Homo sapiens
  misc_feature (546)..(546): n is a, c, g, or t/u
  misc_feature (559)..(559): n is a, c, g, or t/u
  misc_feature (601)..(601): n is a, c, g, or t/u
  misc_feature (684)..(684): n is a, c, g, or t/u
gtatcgtggaaagggagagtggccactatgtggagatgcacgcccgctatatagggaccacagtgtttgtgcggcaggtgggtcgctacctgacccttgccatccgtatgcctgaagacctggccatgtcctacgaggagagccaggacctgcagctgtgcgtgaacggctgccccctgagtgaacgcatcgatgacgggcagggccaggtgtctgccatcctgggacacagcctgcctcgcacctccttggtgcaggcctggcctggctacacactggagactgccaacactcaatgccatgagaagatgccagtgaaggacatctatttccagtcctgtgtcttcgacctgctcaccactggtgatgccaactttactgccgcagcccacagtgccttggaggatgtggaggccctgcacccaaggaaggaacgctggcacattttccccagcagtggcaatgggactccccgtggaggcagtgatttgtctgtcagtctaggactcacctgcttgatccttatcgtgtttttgtaggggttgncttttgttttggntttttattttttgctataacaaaattttaaaatatatattgncataatatattgagtaaaagagtatatatgtatataccatgtatatgacaagatgtttgtcctgggacacccaccaagattgncatactgggtttggttggtttcacatatgttggatgtagggtctttgaatggatcaattttggttggag

SEQ ID NO: 462 - DNA, 766 bp, Homo sapiens
  misc_feature (7)..(7): n is a, c, g, or t/u
  misc_feature (76)..(76): n is a, c, g, or t/u
  misc_feature (125)..(125): n is a, c, g, or t/u
  misc_feature (139)..(139): n is a, c, g, or t/u
  misc_feature (160)..(160): n is a, c, g, or t/u
  misc_feature (199)..(199): n is a, c, g, or t/u
  misc_feature (217)..(217): n is a, c, g, or t/u
  misc_feature (230)..(230): n is a, c, g, or t/u
  misc_feature (259)..(259): n is a, c, g, or t/u
  misc_feature (274)..(274): n is a, c, g, or t/u
  misc_feature (327)..(327): n is a, c, g, or t/u
  misc_feature (363)..(363): n is a, c, g, or t/u
  misc_feature (399)..(399): n is a, c, g, or t/u
  misc_feature (484)..(484): n is a, c, g, or t/u
  misc_feature (502)..(502): n is a, c, g, or t/u
  misc_feature (552)..(552): n is a, c, g, or t/u
  misc_feature (572)..(572): n is a, c, g, or t/u
  misc_feature (575)..(575): n is a, c, g, or t/u
  misc_feature (578)..(578): n is a, c, g, or t/u
  misc_feature (605)..(605): n is a, c, g, or t/u
  misc_feature (647)..(647): n is a, c, g, or t/u
  misc_feature (662)..(662): n is a, c, g, or t/u
  misc_feature (694)..(694): n is a, c, g, or t/u
  misc_feature (719)..(719): n is a, c, g, or t/u
  misc_feature (734)..(734): n is a, c, g, or t/u
  misc_feature (736)..(736): n is a, c, g, or t/u
gcaaggnatgtaactttatttttctagcataataatttaaagtatttacacactgcacactcactgttttacacanatacgtattcatatatctatgaaccacatctaaaggtttctttgcaaanactcgacacactgngggggggggagcttccaagcntaacaaagaggacaaaaaaaagttttgagtcttttaaanacagccatgtggagcatntgtgaaaaccagngtttcccccgttttaagctcccccagganacctctgaacagctntagcctatccacatgttggtatgacctgaaattcttctagctaaggtttcaanaaccaacatgtgcaagcagcattttttctagaaatntcaaaaaaggagaaaataaacctggcccttacgtanagaaatacatctatttctgaaagtaatctgtggggattgttttacagggacaccgattacaagggcagaatagcaaaatacactnttactagtgatgcagggngcttttaaatgtccttccactaaatgatatggcaaaataacccaatcttnttttcccaactatcagtaanggnggntggtattttccctgaaaaagagcaaanggttttttattaatgatacacactctaaacccaaacctatanaaattcttctattgnttttacttcactttcatctatttgccaaaaanagggggtatcccccgattttttccnccttggcccccccantnttaaacaaatttttaccatgcttttgaatt

SEQ ID NO: 463 - DNA, 827 bp, Homo sapiens
  misc_feature (555)..(555): n is a, c, g, or t/u
  misc_feature (627)..(627): n is a, c, g, or t/u
  misc_feature (664)..(664): n is a, c, g, or t/u
  misc_feature (678)..(678): n is a, c, g, or t/u
  misc_feature (720)..(720): n is a, c, g, or t/u
  misc_feature (735)..(735): n is a, c, g, or t/u
  misc_feature (744)..(744): n is a, c, g, or t/u
  misc_feature (753)..(753): n is a, c, g, or t/u
  misc_feature (762)..(762): n is a, c, g, or t/u
  misc_feature (783)..(783): n is a, c, g, or t/u
  misc_feature (785)..(785): n is a, c, g, or t/u
  misc_feature (792)..(792): n is a, c, g, or t/u
  misc_feature (822)..(822): n is a, c, g, or t/u
gctgtcagaaaaattttttaaagcagcctctaattgtggcattgtagaaagtatcctgaactgggtgaaatttaaggctcagactcagctgaataagaagtgttcatcagtaaaatacagtaaaatcaaaggtattcccaaactggatgatgctaatgatgctggtggtaaacattccctggagtgtacactgatattaacagagggagactctgccaaatcactggctgtgtctggattaggtgtgattggacgagacagatacggagtttttccactcaggggcaaaattcttaatgtacgggaagcttctcataaacagatcatggaaaatgctgaaataaataatattattaaaatagttggtctacaatataagaaaagttacgatgatgcagaatctctgaaaaccttacgctatggaaagattatgattatgaccgatcaggatcaagatggttctcacataaaaggcctgcttattaatttcatccatcacaattggccatcacttttgaagcatggttttcttgaagagttcattactcctattgnaaaggcaagcaaaaataagcaggaactttccttctacagtattcctgaatttgcgaatggaaaaaacatatngaaaaccagaaagcctggaaaataaagtactattaangattgggtctagtncagcttaaagaagcaaaggatattttggtgaattggaaaagngtcgcatttggttanatatctggncctgaaaangaagctgcnttaaccttggcttttagtaananaaaatgntgaccgaaaaaaaatggttaacaaattttntggaa

SEQ ID NO: 464 - DNA, 708 bp, Homo sapiens
  misc_feature (12)..(12): n is a, c, g, or t/u
  misc_feature (48)..(48): n is a, c, g, or t/u
  misc_feature (52)..(52): n is a, c, g, or t/u
  misc_feature (55)..(55): n is a, c, g, or t/u
  misc_feature (69)..(69): n is a, c, g, or t/u
  misc_feature (72)..(72): n is a, c, g, or t/u
  misc_feature (81)..(81): n is a, c, g, or t/u
  misc_feature (89)..(89): n is a, c, g, or t/u
  misc_feature (91)..(91): n is a, c, g, or t/u
  misc_feature (100)..(100): n is a, c, g, or t/u
  misc_feature (102)..(102): n is a, c, g, or t/u
  misc_feature (106)..(106): n is a, c, g, or t/u
  misc_feature (120)..(120): n is a, c, g, or t/u
  misc_feature (123)..(123): n is a, c, g, or t/u
  misc_feature (127)..(127): n is a, c, g, or t/u
  misc_feature (133)..(133): n is a, c, g, or t/u
  misc_feature (145)..(145): n is a, c, g, or t/u
  misc_feature (147)..(147): n is a, c, g, or t/u
  misc_feature (149)..(149): n is a, c, g, or t/u
  misc_feature (162)..(162): n is a, c, g, or t/u
  misc_feature (182)..(182): n is a, c, g, or t/u
  misc_feature (191)..(191): n is a, c, g, or t/u
  misc_feature (197)..(197): n is a, c, g, or t/u
  misc_feature (208)..(208): n is a, c, g, or t/u
  misc_feature (211)..(211): n is a, c, g, or t/u
  misc_feature (214)..(214): n is a, c, g, or t/u
  misc_feature (216)..(216): n is a, c, g, or t/u
  misc_feature (219)..(219): n is a, c, g, or t/u
  misc_feature (222)..(222): n is a, c, g, or t/u
  misc_feature (224)..(224): n is a, c, g, or t/u
  misc_feature (234)..(234): n is a, c, g, or t/u
  misc_feature (238)..(238): n is a, c, g, or t/u
  misc_feature (251)..(251): n is a, c, g, or t/u
  misc_feature (256)..(256): n is a, c, g, or t/u
  misc_feature (261)..(261): n is a, c, g, or t/u
  misc_feature (264)..(264): n is a, c, g, or t/u
  misc_feature (270)..(270): n is a, c, g, or t/u
  misc_feature (274)..(274): n is a, c, g, or t/u
  misc_feature (303)..(303): n is a, c, g, or t/u
  misc_feature (307)..(307): n is a, c, g, or t/u
  misc_feature (344)..(344): n is a, c, g, or t/u
  misc_feature (356)..(356): n is a, c, g, or t/u
  misc_feature (358)..(358): n is a, c, g, or t/u
  misc_feature (364)..(364): n is a, c, g, or t/u
  misc_feature (373)..(373): n is a, c, g, or t/u
  misc_feature (382)..(382): n is a, c, g, or t/u
  misc_feature (387)..(387): n is a, c, g, or t/u
  misc_feature (393)..(393): n is a, c, g, or t/u
  misc_feature (415)..(415): n is a, c, g, or t/u
  misc_feature (432)..(432): n is a, c, g, or t/u
  misc_feature (470)..(470): n is a, c, g, or t/u
  misc_feature (495)..(495): n is a, c, g, or t/u
  misc_feature (498)..(498): n is a, c, g, or t/u
  misc_feature (505)..(505): n is a, c, g, or t/u
  misc_feature (510)..(510): n is a, c, g, or t/u
  misc_feature (548)..(548): n is a, c, g, or t/u
  misc_feature (562)..(562): n is a, c, g, or t/u
  misc_feature (573)..(573): n is a, c, g, or t/u
  misc_feature (592)..(592): n is a, c, g, or t/u
  misc_feature (601)..(601): n is a, c, g, or t/u
  misc_feature (633)..(633): n is a, c, g, or t/u
  misc_feature (637)..(637): n is a, c, g, or t/u
  misc_feature (650)..(650): n is a, c, g, or t/u
  misc_feature (657)..(657): n is a, c, g, or t/u
  misc_feature (667)..(667): n is a, c, g, or t/u
  misc_feature (674)..(674): n is a, c, g, or t/u
  misc_feature (676)..(676): n is a, c, g, or t/u
  misc_feature (694)..(694): n is a, c, g, or t/u
cccatttttaangtttaaatttcatttcaaaaagcaggtctgtagttngtanccntgacaattaaaatntgngctaatgcncggcagtntntaacaattntncaanccaatcaaacagtncgngacntttcantgagtaaaaaanancntaaaactgtttgngtaaaaacaaaatgttaaanggcctcccncaatantaaaaaaccgncanttncntcntcncnttaaaataanccanatgtccaaaagtntgagncaganaanacaaanggcnccccaagatttttgttgaaaaatgtttgngctntttgggcccttaattaaacattgcaaaatcaacatcnttttttttttcntnaaactntgcaaaatnttttacttntttcntacccnaccggttcgtggcaaaaaaggnggctcattagggaagtntgaggggaaaatgtccacatctgaatcctgatcaaaanatgtcttcttcggtttcttgcttgnggntttggangtttncctgccagggttataatcgccttcattttcaaagccanatgctttccttttntttgcccctcngcctttaccttttgggggnggaggcttnttttggaatgccaaattctgaatcccgagcanaagnttacagccctttnttctttnttttgttttnggggttntnttgggcttaaggactggntttgaaaacggttt

SEQ ID NO: 465 - DNA, 774 bp, Homo sapiens
  misc_feature (472)..(472): n is a, c, g, or t/u
  misc_feature (479)..(479): n is a, c, g, or t/u
  misc_feature (499)..(499): n is a, c, g, or t/u
  misc_feature (528)..(528): n is a, c, g, or t/u
  misc_feature (612)..(612): n is a, c, g, or t/u
  misc_feature (621)..(621): n is a, c, g, or t/u
  misc_feature (651)..(651): n is a, c, g, or t/u
  misc_feature (656)..(656): n is a, c, g, or t/u
  misc_feature (691)..(691): n is a, c, g, or t/u
  misc_feature (696)..(696): n is a, c, g, or t/u
  misc_feature (727)..(727): n is a, c, g, or t/u
  misc_feature (754)..(754): n is a, c, g, or t/u
aggtgggtcgctacctgacccttgccatccgtatgcctgaagacctggccatgtcctacgaggagagccaggacctgcagctgtgcgtgaacggctgccccctgagtgaacgcatcgatgacgggcagggccaggtgtctgccatcctgggacacagcctgcctcgcacctccttggtgcaggcctggcctggctacacactggagactgccaacactcaatgccatgagaagatgccagtgaaggacatctatttccagtcctgtgtcttcgacctgctcaccactggtgatgccaactttactgccgcagcccacagtgccttggaggatgtggaggccctgcacccaaggaaggaacgctggcacattttccccagcagtggcaatgggactccccgtggaggcagtgatttgtctgtcaagtctaggactcacctgcttgatccttatcgtgtttttgtaggggttgncttttgntttggttttttattttttgnctataacaaaattttaaaatatatattgncataatatattgagtaaaaagagtatatatgtatataccatgtatatgacaaggatgtttgtcctgggacacccaccagattgnacatactgngtttggctggtttcacatattgttggatgnaaagntctttgattggatcaattttggtttgcagttctgngaaangtttataatgtccttgccaaggacctggtanaaacactttattttttatatattaaanatttatggggggcctgggtg

SEQ ID NO: 466 - DNA, 778 bp, Homo sapiens
  misc_feature (167)..(167): n is a, c, g, or t/u
  misc_feature (206)..(206): n is a, c, g, or t/u
  misc_feature (266)..(266): n is a, c, g, or t/u
  misc_feature (334)..(334): n is a, c, g, or t/u
  misc_feature (365)..(365): n is a, c, g, or t/u
  misc_feature (509)..(509): n is a, c, g, or t/u
  misc_feature (581)..(581): n is a, c, g, or t/u
  misc_feature (584)..(584): n is a, c, g, or t/u
  misc_feature (597)..(597): n is a, c, g, or t/u
  misc_feature (617)..(617): n is a, c, g, or t/u
  misc_feature (639)..(639): n is a, c, g, or t/u
  misc_feature (655)..(655): n is a, c, g, or t/u
  misc_feature (670)..(670): n is a, c, g, or t/u
  misc_feature (714)..(714): n is a, c, g, or t/u
  misc_feature (732)..(732): n is a, c, g, or t/u
  misc_feature (740)..(740): n is a, c, g, or t/u
  misc_feature (750)..(750): n is a, c, g, or t/u
  misc_feature (767)..(767): n is a, c, g, or t/u
ccacagcaaggtatgtaactttatttttctagcataataatttaaagtatttacacactgcacactcactgttttacacagatacgtattcatatatctatgaaccacatctaaaggtttctttgcaaagactcgacacactgtgggggggggggagcttccaagcntaacaaagaggacaaaaaaaagttttgagtcttttaaanacagccatgtggagcatctgtgaaaaccagtgtttcccccgttttaagctcccccagganacctctgaacagctatagcctatccacatgttggtatgacctgaaattcttctagctaaggtttcaanaaccaacatgtgcaagcagcattttttctanaaatctcaaaaaaggagaaaataaacctggcccttacgtagagaaatacatctatttctgaaagtaatctgtggggattgttttacagggacaccgattacaagggcagaatagcaaaatacactattactagtgatgcagggngcttttaaatgtcacttccagctaaatgatatggcaaaataacccaatcttcttttcccactatcaagtaanggngggtggtattttncctgaaaagagcaaaggttntttattaatgatacacactctnaacccagatcctttanaaattcttctattgnttttacttcactttcatacttttgcacaaaaaaaggggggtatncccccgattttttcctcncttgggcntcccaaattntaaaacaaatttttacnatgcttctgaa

SEQ ID NO: 467 - DNA, 726 bp, Homo sapiens
  misc_feature (114)..(114): n is a, c, g, or t/u
  misc_feature (612)..(612): n is a, c, g, or t/u
  misc_feature (674)..(674): n is a, c, g, or t/u
  misc_feature (706)..(706): n is a, c, g, or t/u
  misc_feature (714)..(714): n is a, c, g, or t/u
gagaaatcactgaattaaaagtaaaagaatttgaaaatatcaaattacagcttcaagaaaaccatgaagatgaagtgaaaaaagtaaaagcggaagtagaggatttaaagtatnttctggaccagtcacaaaaggagtcacagtgtttaaaatctgaacttcaggctcaaaaagaagcaaattcaagagctccaacaactacaatgagaaatctagtagaacggctaaagagccaattagccttgaaggagaaacaacagaaagcacttagtcgggcacttttagaactccgggcagaaatgacagcagctgctgaagaacgtattatttctgcaacttctcaaaaagaggcccatctcaatgttcaacaaatcgttgatcgacatactagagagctaaagacacaagttgaagatttaaatgaaaatcttttaaaattgaaagaagcacttaaaacaagtaaaaacagagaaaactcactaactgataatttgaatgacttaaataatgaactgcaaaagaaacaaaaagcctataataaaatacttagagagaaagaggaaattgatcaagagaatgatgaactgaaaaggcaaattaaaagactaaccngtggattacagggcaaacccctgacagataataaaccaaggtctaattggagaaactccaanggaaggttaaaaacttgagaacccatttttangggaaggngggaggaagtaa

SEQ ID NO: 468 - DNA, 704 bp, Homo sapiens
  misc_feature (45)..(45): n is a, c, g, or t/u
  misc_feature (207)..(207): n is a, c, g, or t/u
  misc_feature (275)..(275): n is a, c, g, or t/u
  misc_feature (316)..(316): n is a, c, g, or t/u
  misc_feature (406)..(406): n is a, c, g, or t/u
  misc_feature (425)..(425): n is a, c, g, or t/u
  misc_feature (475)..(475): n is a, c, g, or t/u
  misc_feature (558)..(558): n is a, c, g, or t/u
  misc_feature (608)..(608): n is a, c, g, or t/u
  misc_feature (612)..(612): n is a, c, g, or t/u
  misc_feature (626)..(626): n is a, c, g, or t/u
  misc_feature (642)..(642): n is a, c, g, or t/u
  misc_feature (679)..(679): n is a, c, g, or t/u
  misc_feature (683)..(683): n is a, c, g, or t/u
  misc_feature (697)..(697): n is a, c, g, or t/u
catataattttatttattaagaattccaatctaagtataaaggtncaaggtagtgagaaggaaatactacagttcggagaactgcttatttccaagtatatttaacttataaagttaataaatagttaaatgaaacaaagtttataggtgacctttagtaaatggggaaattaacaggactttcttcttcatcttcaaactcttcanaagcagcaacagggctagttaattcaactcccaattgttctgaaagtttttttaccttctcttctaanagaatattcttcttcacttcttccttgtaattatacttaanatcttcaatttcttcaaaaaatgaaggatcaaaattttccagttcttttttcagcttctttatttcctccttcaaatgctgcttttctanatctgacattttgagctgngtctctagatcttttattttttcctttagttgatcagcatcaggtatggngctttcagctccactttggtccttggtagcttctatctgatggattaattctgctttctctttatcagctggatgattagctnatctaaaaacctggaagctccctttaaaggcctgctctgtctcaaccccntcangaacatggtttaanaatcttaatctggtgntcaagggcttcattggatttgggaaacctttttgggncccnctctgggggcctcntttacaa

SEQ ID NO: 469 - DNA, 763 bp, Homo sapiens
  misc_feature (420)..(420): n is a, c, g, or t/u
  misc_feature (666)..(666): n is a, c, g, or t/u
  misc_feature (714)..(714): n is a, c, g, or t/u
  misc_feature (723)..(723): n is a, c, g, or t/u
gccgggagttggagcctgcggagttcgagaccatgctgctgttctgccccggctgcgggaacgggctgatcgtggaggagggacaacgctgccaccgcttcgcctgcaacacgtgcccctacgtgcacaacatcacccgcaaggtaacaaatcggaagtacccaaaactgaaagaagtggatgatgtgcttggtggagcagctgcctgggagaatgttgactctactgcagagtcgtgtcccaaatgcgaacatcctcgtgcttacttcatgcagcttcagacccgctctgcagatgagccgatgaccaccttctacaagtgctgcaatgctcagtgtggacaccgctggagggattagggccaggatggcccagctgccctagtgtgtgcttgccttgtccctcggggtagatgcttanctggcagtatgagttgtgtgtcctgagggtctttgctagtgtggtggaaagataaaccttttgaggtgaagagccagggggtcaggaaatatggcctatctgccaggcagggtggatgaagtcatgaatgtctgggagtttttctgtgtggggaggagacagagacccataactaaatatgctcttgtgtaaaagtcctattctttcatcttccaatttattggcaattgacattccctttaactnccaatcaaacactcttaaaatattttgtacctgtttgtaaaacttaantacatggtnccctaaaatattttaacctgttactttggaaaacttgggg

SEQ ID NO: 470 - DNA, 706 bp, Homo sapiens
  misc_feature (136)..(136): n is a, c, g, or t/u
  misc_feature (502)..(502): n is a, c, g, or t/u
  misc_feature (628)..(628): n is a, c, g, or t/u
  misc_feature (655)..(655): n is a, c, g, or t/u
  misc_feature (672)..(672): n is a, c, g, or t/u
gcaatattccaactttcatttaaatgaaatattcagaattttgattaaaataaataataaattacacaagtttacaagtaacagttaaatatttagggacatgtactaagttttacaaacagtacaaatatttaanagtgttgattgggagtaagggaatgtcaactgccaataaagtggaagatgaaagaataggactttacacagagcatatttagttatgggtctctgtctcctccccacacagaaaaactcccagacattcatgacttcatccaccctgcctggcagataggccatatttcctgaccccctggctcttcacctcaaaaggtttatctttccaccacactagcaaagaccctcaggacacacaactcatactgccagctaagcatctaccccgagggacaaggcaagcacacactagggcagctgggccatcctggccctaatccctccagcggtgtccacactgagcattgcagcacttgtagaaggnggtcatcggctcatctgcagagcgggtctgaagctgcatgaagtaagcacgaggatgttcgcatttgggacacgactctgcagtagagtcaacattctcccaagcagctgctccaccaagcacatnatccacttctttcagttttgggtcttncgatttgttaccttgcnggtgatgttgtgcacgtagggggcacgtgttgca

SEQ ID NO: 471 - DNA, 715 bp, Homo sapiens
  misc_feature (586)..(586): n is a, c, g, or t/u
  misc_feature (598)..(598): n is a, c, g, or t/u
  misc_feature (638)..(638): n is a, c, g, or t/u
  misc_feature (640)..(640): n is a, c, g, or t/u
  misc_feature (684)..(684): n is a, c, g, or t/u
gctgcaagatataaaagaaaaaatcagtaagggagaatatggaaacgctggtatcatggctgaagtggaagagctcaggaaacgtgtgctagatatggaagggaaagatgaagagctcataaaaatggaggagcagtgcagagatctcaataagaggcttgaaagggagacgttacagagtaaagactttaaactagaggttgaaaaactcagtaaaagaattatggctctggaaaagttagaagacgctttcaacaaaagcaaacaagaatgctactctctgaaatgcaatttagaaaaagaaaggatgaccacaaagcagttgtctcaagaactggagagtttaaaagtaaggatcaaagagctagaagccattgaaagtcggctagaaaagacagaattcactctaaaagaggatttaactaaactgaaaacattaactgtgatgtttgtagatgaacggaaaacaatgagtgaaaaattaaagaaaactgaagataaattacaagctgcttcttctcagcttcaagtggagcaaaataaagtaacaacagttactgagaaagttaattgaggaaactaaaanggcgctcaagtnccaaacccgtgttgaagaaaagatgttcgccgttacccangngagagatgattttaaaaacaaaattgaagccggagaaaagaaanggaatgtctcctgtcaagagttatatgttgg

SEQ ID NO: 472 - DNA, 716 bp, Homo sapiens
  misc_feature (542)..(542): n is a, c, g, or t/u
  misc_feature (548)..(548): n is a, c, g, or t/u
  misc_feature (600)..(600): n is a, c, g, or t/u
  misc_feature (611)..(611): n is a, c, g, or t/u
  misc_feature (641)..(641): n is a, c, g, or t/u
  misc_feature (657)..(657): n is a, c, g, or t/u
  misc_feature (672)..(672): n is a, c, g, or t/u
  misc_feature (693)..(693): n is a, c, g, or t/u
aaaaataacaaattatttactgttttataatgttaaagtatttcaccaagacaagttgcagtcaaattaaagtgagttatggaaaatgaaatacataaagatgtatttatacaagtgcagactaaatattttccatacaagtatgtaaatgaaaagatatacagtaagtgcacactcgatatgactatgcaggcaacagttagtttcagatactcttgtatagttcatgcacaaaccttcccaaagtacgagttcagtcagtcttgggggatatggagggatgattaaaaaaggattgagttccttgcaaaaatatcagtatggactggatgagggtgagcgtggtcagttatatatattacttactgtaatttgtgattgtcgaggaagaggtgtggctgttggtgtgatagtaatactgctggtgactttattggttgttttgtttagtgccccgttaattaagccttgagttcggttatcctgcagtggtgctgaagggctggcaggtctcacagggctggctacagcttgcatgtaangacttnctaagtgaatgtggatttattatcctcagagttatcccacttgagctattgntggtttgaacnctgaaactgccatgatgacttgccggtctnggggagactcttgaanttcgcatgcctggcncctggatttctggtgggtctnggggagcggtccctgctcaagga

SEQ ID NO: 473 - DNA, 671 bp, Homo sapiens
gtaagagttgactctacagcaaaggttgcagaaatagaacatgcggaaaaggaaaaaatgaaggagaaagttgaacgtattcttaagcatggaataaattgctttattaacaggcaattaatttataattatcctgaacagctctttggtgctgctggtgtcatggctattgagcatgcagattttgcaggtgtggaacgcctagctcttgtcacaggtggtgaaattgcctctacctttgatcacccagaactggtgaagcttggaagttgcaaacttatcgaggaagtcatgattggagaagacaaactcattcacttttctggggttgcccttggtgaggcttgtaccattgttttgcgtggtgccactcaacaaattttagatgaagcagaaagatcattgcatgatgctctttgtgttcttgcgcaaactgtaaaggactctagaacagtttatggaggaggctgttctgagatgttgatggctcatgctgtgacacagcttgccaatagaacaccaggcaaagaagctgttgcaatggagtcttatgctaaagcactgagaatgttgccaaccatcatagctgacaatgcagctatgacagtgcaaacctggtggcacagctcaaggctgctccagtgaaggcatcccctgctggattggattga

SEQ ID NO: 474 - DNA, 737 bp, Homo sapiens
  misc_feature (608)..(608): n is a, c, g, or t/u
  misc_feature (651)..(651): n is a, c, g, or t/u
  misc_feature (664)..(664): n is a, c, g, or t/u
  misc_feature (668)..(668): n is a, c, g, or t/u
  misc_feature (698)..(698): n is a, c, g, or t/u
ctcacggacaagaacctcagataggttaaataggattgcgaatcaggtggccattcagcggaagaagcagtttgtggagcgagcccacagctactggctgctcaagcggctgtccaggaacggggcccccctgctgcggcggctgcagtccagcctgcagtctcagcgaagctcacagcagagagaaaatgatgaggagatgaaggctgccaaagagaagctgaagtactggcagcggctgcggcacgacctggagcgcgctcgcctgctgatcgagctgctgcgcaagcgggagaagctcaagcgtgagcaggtgaaggtggagcaggtcgccatggagctgcggctgaccccgctgacggtgctgctgcgctcagtgctggaccagctgcaagacaaggaccccgccaggatatttgcgcagcccgtgagtctgaaggaggtaccagattatttggatcacattaaacatcccatggactttgccacaatgaggaaacggttagaagctcaagggtataaaaacctccatgagtttgaggaggattttgatctcattatagataactgcatgaagtacaatgccagggacaccgtgttctataaancccgcggtgaagcttgcgccatcaaggaggtgttgtttctgangcaagccccgccncgangtgggacaagcatccgcttgggaaaaaggncttcggggattgccccttgcctgaagccgggcttgcttg

SEQ ID NO: 475 - DNA, 780 bp, Homo sapiens
  misc_feature (250)..(250): n is a, c, g, or t/u
  misc_feature (395)..(395): n is a, c, g, or t/u
  misc_feature (477)..(477): n is a, c, g, or t/u
  misc_feature (557)..(557): n is a, c, g, or t/u
  misc_feature (677)..(677): n is a, c, g, or t/u
  misc_feature (690)..(690): n is a, c, g, or t/u
  misc_feature (696)..(696): n is a, c, g, or t/u
  misc_feature (703)..(703): n is a, c, g, or t/u
  misc_feature (720)..(720): n is a, c, g, or t/u
  misc_feature (736)..(736): n is a, c, g, or t/u
  misc_feature (742)..(742): n is a, c, g, or t/u
ccaaatcttgactttatttttaatataaaaaatgcaaatttggaaacccaccctactttccccaacataatgctttacctcttaaaaataaaaataaagtactaattctatatacatcacaggtaccatacaaaaatgtatccaaagtttctattgctaccaaagtgttctaaattaaaacaagttacagaaagcccctcattgtaaacaaaagattacaagttataaaatcaaagtacacacaggccanagtcatttatacaatgcaatgcattctgctcccaagccaagttgaatttttatgtgcctgtataaaaatgcatatcaatatacctttgcaaatgtatttttcattataaagcaaatgaatacactttctacaataaataatccgntgggaggcacacctgcggggtttgaggtgggcgggacgacgggagcggggacacacccaccggcggtcacgggcagcggagngtttttggtgatctgcaagtgatgtacacagcataactttattctcccctctttccacaaagtaccattcaaaataatgncattttctttcttaaaatacacatttgtcattgtaaatttacatcccgtcttattaaataagtggtctctgtgtaaagagcatgatttacaaaattattaaacattcaaaagtctttaanaaaaagctacatntcaaanaaagggnaccccagcaacaccggnctgggggacgtgcganaaaacncactgggcttggcccggacgtgcccccccccatttaca

SEQ ID NO: 476 - DNA, 738 bp, Homo sapiens
  misc_feature (620)..(620): n is a, c, g, or t/u
  misc_feature (633)..(633): n is a, c, g, or t/u
  misc_feature (661)..(661): n is a, c, g, or t/u
  misc_feature (686)..(686): n is a, c, g, or t/u
  misc_feature (709)..(709): n is a, c, g, or t/u
agaagccagagctccagcggcgccgcggggcggcagtcaagaccagagccggagccgtcactcacctctggattagcctgaagcggagactaccggctgcggagcggcggggcgagacacttgctcgccttttgaccccatcatgtcgcggggctccatcgagattcccctccgggacactgacgaggtcattgaacttgacttcgatcagttaccggagggagatgaagttatcagtattctgaaacaggaacacacacaactgcacatatggattgctttggcgctggaatactacaagcaaggaaaaacagaagagtttgtaaaattgttggaagcagcacgtatagatggcaatttggactatagagaccatgaaaaagaccagatgacttgcttggatacattggcagcgtattatgtacaacaggctcggaaagaaaagaataaggacaataaaaaggatcttattacacaggccaccttgttgtatacaatggccgataaaattattatgtatgatcagaaccatttgttgggaagagcctgcttctgcctacttgagggtgacaaaatggatcaagctgatgcacagtttcattttgtactcaatcagtctncaaataatatttncagcccttcttggtaaaacttgcatttncttcaacaagaaaggatttcagganggagctcttggcttactattaanaaagcattgcgtactaaccccaggattgt

SEQ ID NO: 477 - DNA, 766 bp, Homo sapiens
  misc_feature (6)..(6): n is a, c, g, or t/u
  misc_feature (12)..(12): n is a, c, g, or t/u
  misc_feature (19)..(19): n is a, c, g, or t/u
  misc_feature (29)..(29): n is a, c, g, or t/u
  misc_feature (60)..(60): n is a, c, g, or t/u
  misc_feature (62)..(62): n is a, c, g, or t/u
  misc_feature (77)..(77): n is a, c, g, or t/u
  misc_feature (82)..(82): n is a, c, g, or t/u
  misc_feature (87)..(87): n is a, c, g, or t/u
  misc_feature (89)..(89): n is a, c, g, or t/u
  misc_feature (100)..(101): n is a, c, g, or t/u
  misc_feature (103)..(103): n is a, c, g, or t/u
  misc_feature (113)..(113): n is a, c, g, or t/u
  misc_feature (115)..(115): n is a, c, g, or t/u
  misc_feature (119)..(119): n is a, c, g, or t/u
  misc_feature (123)..(124): n is a, c, g, or t/u
  misc_feature (130)..(130): n is a, c, g, or t/u
  misc_feature (133)..(135): n is a, c, g, or t/u
  misc_feature (137)..(137): n is a, c, g, or t/u
  misc_feature (142)..(142): n is a, c, g, or t/u
  misc_feature (154)..(154): n is a, c, g, or t/u
  misc_feature (165)..(166): n is a, c, g, or t/u
  misc_feature (173)..(173): n is a, c, g, or t/u
  misc_feature (186)..(187): n is a, c, g, or t/u
  misc_feature (194)..(195): n is a, c, g, or t/u
  misc_feature (203)..(203): n is a, c, g, or t/u
  misc_feature (216)..(216): n is a, c, g, or t/u
  misc_feature (221)..(221): n is a, c, g, or t/u
  misc_feature (241)..(241): n is a, c, g, or t/u
  misc_feature (252)..(252): n is a, c, g, or t/u
  misc_feature (261)..(261): n is a, c, g, or t/u
  misc_feature (268)..(268): n is a, c, g, or t/u
  misc_feature (278)..(278): n is a, c, g, or t/u
  misc_feature (288)..(289): n is a, c, g, or t/u
  misc_feature (291)..(291): n is a, c, g, or t/u
  misc_feature (296)..(296): n is a, c, g, or t/u
  misc_feature (312)..(312): n is a, c, g, or t/u
  misc_feature (315)..(315): n is a, c, g, or t/u
  misc_feature (324)..(324): n is a, c, g, or t/u
  misc_feature (327)..(327): n is a, c, g, or t/u
  misc_feature (352)..(353): n is a, c, g, or t/u
  misc_feature (362)..(362): n is a, c, g, or t/u
  misc_feature (370)..(370): n is a, c, g, or t/u
  misc_feature (382)..(382): n is a, c, g, or t/u
  misc_feature (388)..(388): n is a, c, g, or t/u
  misc_feature (393)..(393): n is a, c, g, or t/u
  misc_feature (399)..(400): n is a, c, g, or t/u
  misc_feature (402)..(402): n is a, c, g, or t/u
  misc_feature (404)..(405): n is a, c, g, or t/u
  misc_feature (479)..(479): n is a, c, g, or t/u
  misc_feature (493)..(493): n is a, c, g, or t/u
  misc_feature (514)..(514): n is a, c, g, or t/u
  misc_feature (516)..(516): n is a, c, g, or t/u
  misc_feature (526)..(526): n is a, c, g, or t/u
  misc_feature (551)..(551): n is a, c, g, or t/u
  misc_feature (559)..(559): n is a, c, g, or t/u
  misc_feature (616)..(616): n is a, c, g, or t/u
  misc_feature (633)..(633): n is a, c, g, or t/u
  misc_feature (686)..(686): n is a, c, g, or t/u
  misc_feature (713)..(713): n is a, c, g, or t/u
  misc_feature (729)..(729): n is a, c, g, or t/u
  misc_feature (736)..(736): n is a, c, g, or t/u
aaaagntggtanaagaatnctattattangtggcttaagtcggttttagctgtctactancngaaaagcattttccncaccntattnancctaacacatnntncatttgggancntatntacnncgatgnccnnntncactnttgaaaaccttnctttcaaatgnnctttggngcaaggatacagnntatatcnntgccttcnaaaaataaaaatnttctnaatctaacctcaaaatggantaaagacatcnatccctagnttgcgcnccacttggtnaaagaccgcnntnaaaancaaaagagtatgctgnttnccatatacngangatgagacgtctgccacagtggcanncaaaccttngtaggaangatttaccatcngggttnattgntactgnngntnncacatatgatagggcggaattgctccacaaagaatagtctcatttgcacgagagactcaaatattggactctancacaggaaatgtcnattggggctcacaaatatacnanctgatagaanagaaaattgccttaagaaaaatttnacaattgnctaaacatctgaaacatttttatcacagctttcatatattaaaaaagtttcctccanaaatgaagcttattgangaaataaaacctagtcactatcatctgacccatgttctgagcctttatctgangccttgggtggtggatccctttggttncgattcatttccaaancctttgnaccggaaccctcatttgttaggaacctctt

SEQ ID NO: 478 - DNA, 591 bp, Homo sapiens
  misc_feature (8)..(8): n is a, c, g, or t/u
  misc_feature (586)..(586): n is a, c, g, or t/u
agaacggnaactagaaagagcgagagaaagggataaagaacgagaacgccaaagggattgggaagacaaagacaaaggacgagatgaccgcagagaaaagcgagaagagatccgagaagataggaatccaagagatggacatgatgaaagaaaatcaaagaagcgctatagaaatgaagggagtcccagccctagacagtccccgaagcgccggcgtgaacattctccggacagtgatgcctacaacagtggagatgataaaaatgaaaaacacagactcttgagccaagttgtacgacctcaagaatctcgttctcttagtccctcgcacctcacagaagacagacagggtagatggaaagaggaggatcgtaaaccagaaaggaaagagagttcaaggcgctacgaagaacaggaactcaaggagaaagtttcttctgtcgataaacagagagaacagacagaaatcctggaaagctcaagaatgcgtgcacaggacattataggacaccaccagtctgaagatcgagagacatctgatcgagctctgatgaaaacaagaagaaagccaaaattcaaagaaccnatttt

SEQ ID NO: 479 - DNA, 583 bp, Homo sapiens
  misc_feature (3)..(4): n is a, c, g, or t/u
  misc_feature (7)..(7): n is a, c, g, or t/u
  misc_feature (49)..(49): n is a, c, g, or t/u
  misc_feature (56)..(56): n is a, c, g, or t/u
  misc_feature (63)..(63): n is a, c, g, or t/u
  misc_feature (85)..(85): n is a, c, g, or t/u
  misc_feature (95)..(95): n is a, c, g, or t/u
  misc_feature (100)..(100): n is a, c, g, or t/u
  misc_feature (103)..(103): n is a, c, g, or t/u
  misc_feature (166)..(166): n is a, c, g, or t/u
  misc_feature (192)..(192): n is a, c, g, or t/u
  misc_feature (204)..(204): n is a, c, g, or t/u
  misc_feature (217)..(217): n is a, c, g, or t/u
  misc_feature (224)..(224): n is a, c, g, or t/u
  misc_feature (231)..(231): n is a, c, g, or t/u
  misc_feature (255)..(255): n is a, c, g, or t/u
  misc_feature (258)..(258): n is a, c, g, or t/u
  misc_feature (282)..(282): n is a, c, g, or t/u
  misc_feature (288)..(288): n is a, c, g, or t/u
  misc_feature (292)..(292): n is a, c, g, or t/u
  misc_feature (295)..(295): n is a, c, g, or t/u
  misc_feature (313)..(313): n is a, c, g, or t/u
  misc_feature (315)..(315): n is a, c, g, or t/u
  misc_feature (343)..(343): n is a, c, g, or t/u
  misc_feature (347)..(347): n is a, c, g, or t/u
  misc_feature (350)..(350): n is a, c, g, or t/u
  misc_feature (368)..(368): n is a, c, g, or t/u
  misc_feature (411)..(411): n is a, c, g, or t/u
  misc_feature (455)..(455): n is a, c, g, or t/u
  misc_feature (490)..(490): n is a, c, g, or t/u
  misc_feature (499)..(499): n is a, c, g, or t/u
  misc_feature (504)..(504): n is a, c, g, or t/u
  misc_feature (507)..(507): n is a, c, g, or t/u
  misc_feature (521)..(523): n is a, c, g, or t/u
  misc_feature (528)..(530): n is a, c, g, or t/u
  misc_feature (548)..(548): n is a, c, g, or t/u
  misc_feature (554)..(554): n is a, c, g, or t/u
  misc_feature (562)..(562): n is a, c, g, or t/u
aannggnttcttttgaatttttgctttcttcttgttttcatcatgagcncgatcanatgtctntcgatcttcaaactgggggggncctataatgncctgngcncccattcttgagctttccaggatttctgtctgttctctctgtttatctacaaaaaaaactttntccttgagttcctgttcttcgtagcnccttgaactctntttcctttctggnttacaancctcctntttccatctaccctgtctgtcttntgngaggggcgagggactaaaaaaacnaaattnttgnggncgtacaacttggctcaanantctgggtttttcatttttatcatctccnctgntgnaggcatcactgtccgganaatgttcaccccggcgcttcggggactgtctagggctgggacncccttcatttctatagccgcttctttgattttctttcatcatgnccatctcttggattcctatcttctcggatcttttntcgcttttntttgnggncatctcggcctttnnntttgnnntccccaaccctttggggntctcgntctttatnccctttttctcgcttttttcg

SEQ ID NO: 480 - DNA, 720 bp, Homo sapiens
  misc_feature (580)..(580): n is a, c, g, or t/u
  misc_feature (594)..(594): n is a, c, g, or t/u
  misc_feature (612)..(612): n is a, c, g, or t/u
  misc_feature (632)..(632): n is a, c, g, or t/u
  misc_feature (675)..(675): n is a, c, g, or t/u
ggcaggacctgtacagtgcccgggacctgcagggcctcaccgtggagcatgccattgattccttccgagaaggggagacaatgattcttaccctcaaggacaaaggcgtgctgcaggaggaggaggacgtgctggtgaacgtgaacctggtggataaggagcgggcagagaaaaatgtggagctgcggaagaagaagcctgactacctgccctatgccgaggacgagagcgtggacgacctggcgcagcaaaaacctcgctctatcctgtccaagtatgacgaagagcttgaaggggagcggccacattccttccgcttggagcagggcggcacggctgatggcctgcgggagcgggagctggaggagatccgggccaagctgcggctgcaggctcagtccctgagcacagtggggccccggctggcctccgaatacctcacgcctgaggagatggtgacctttaaaaagaccaagcggagggtgaagaaaatccgcaagaaggagaaggaggtagtagtgcgggcagatgacttgctgcctctcggggaccagactcaggatggggactttggttccanaactgcgggggacngggtccccccccaatgtnccgaatggaggaagaagaangaaccttgtgccttaacccctggcgtcggacgacacccgaatnggagaacattggacatcattgattaagaaggaaggtggagcttca

SEQ ID NO: 481 - DNA, 582 bp, Homo sapiens
  misc_feature (443)..(443): n is a, c, g, or t/u
aaggagggagctttatttaatatgaaggttgaggcagggccggggcgggagggcgctgtcacttggtgatggtgttcgcgttcatgctcttgccgctgccgctgagcacgatgtagggggtcttctgagccttctgcttctcctggagcagggccacggtgcccaggggcgtgtcgctggagctcatcttcttcaggagcgcctcctcgtccagcttcttcatccgccgctctgtcttcatcttgcctgagcccttgccatggaagcggtgcgacagctgccggaaagcctccttgggtgtgagtttccggcccgtctcatccacgtattcgatcttaacgtcgggtttgtagccgtccttctccttgaagtcctgtgtgaagcctcggtattcctccctccggctgtacttgtcatcgatggccatcttatcctcgatgcantacacggctgagggcagcgacttgttgggggccttacccgggccaccttctgactgtggtctccaacaaccctttgttctgacacaagaacagggcaactgccagccccctattcacgatcgggtcctcgtcaagatgg

SEQ ID NO: 482 - DNA, 704 bp, Homo sapiens
  misc_feature (610)..(610): n is a, c, g, or t/u
aagatggcgaaggtctcagagctttacgatgtcacttgggaagaaatgagagataaaatgagaaaatggagagaagaaaactcaagaaatagtgagcaaattgtggaagttggagaagaattaattaatgaatatgcttctaagctgggagatgatatttggatcatatatgaacaggtgatgattgcagcactagactatggtcgggatgacttggcattgttttgtcttcaagagctgagaagacagttccctggcagtcacagagtcaagcgattaacaggcatgagatttgaagccatggaaagatatgatgatgctatacagctatatgataggattttacaagaagatccaactaacactgctgcaagaaagcgtaagattgccattcgaaaagcccaggggaaaaatgtggaggccattcgggagctgaatgagtatctggaacaatttgttggagaccaagaagcctggcatgaacttgcagaactttacatcaatgaacatgactatgcaaaagcagccttttgtttagaggaactaatgatgactaatccacacaaccacttatactgtcagcagtatgctgaagttaagtatacccaanggtggacttgaaaacctcgaacttttcaagaaagtattttgcacaggccattgaaactggaccacagaaattttgaggagctttggtttggacc

SEQ ID NO: 483 - DNA, 638 bp, Homo sapiens
  misc_feature (288)..(288): n is a, c, g, or t/u
  misc_feature (323)..(323): n is a, c, g, or t/u
  misc_feature (369)..(369): n is a, c, g, or t/u
  misc_feature (490)..(490): n is a, c, g, or t/u
  misc_feature (601)..(601): n is a, c, g, or t/u
caagtttaataaatcatcatggtttatttaacaaggttatactacattagagttttatatatatacatgtatatgtgatatgaagagactgatgtacaatcaataagtcttaaatctctcttccatggatttcccccatctccccacttagcagtaaaaggcatttttaggtttatataaacacattctttacaactgccttcttaacagaaaattactgtagtatataaatagcactgagcatttagtaaataagttacaggccaataagttcaattgtgcagttgngaaatctaatgtcaaagagtttttgaaaccttaanactgggtgatctgcaatgtttccaacatgtcttcgacagccttaanagaatatttggtttccttcttacttcgacctgcaaactgataagctctgtttatttgactagctgcccaactagcatatttcatgttgcctttttcgtttttgcacttgcttttggattanaagcaatatgacttgccgacatataaagtccaaacaaagctctcatatttctgttgttcagtttcaatgcctgtgcaaaatactttcttgaaagttcgagggtttcaagtncaccttgggtatacttaacttcagcatactgctgaca

SEQ ID NO: 484 - DNA, 771 bp, Homo sapiens
ttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagccctcgtagtaacagccattctcatccaaaccccctgaagcttcaccggcgcagtcattctcataatcgcccacggacttacatcctcattactattctgcctagcaaactcaaactacgaacgcactcacagtcgcatcataatcctctctcaaggacttcaaactctactcccactaatagctttttgatgacttctagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacacaatggggctcactcacccaccacattaacaacataaaaccctcattcacacgagaaaacaccctcatgttcatacacctatcccccattctcctcctatccctcaaccccgacatcattaccgggttttcctctt

SEQ ID NO: 485 - DNA, 728 bp, Homo sapiens
  misc_feature (652)..(652): n is a, c, g, or t/u
aattaggagggcactggcccccaacaggcatcaccccgctaaatcccctagaagtcccactcctaaacacatccgtattactcgcatcaggagtatcaatcacctgagctcaccatagtctaatagaaaacaaccgaaaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtagatgtggtttgactatttctgtatgtctccatctattgatgagggtcttaaaaaaaaaaaaaaaaactcgagactagcaagaagaagagaagagaagaaatgccgatatattaaatgaaaaaattagggaagaattaggaagaatcgaagagcagcataggaaagagttagaagtgaaacaacaacttgaacaggctctcagaatacaagatatagaattgaagagtgtagaaagtaatttgaatcangtttctcacactcatgaaaatgaaaattatctcttacatgaaaaattgctggtggaaaaaaggaaattgccatgct

SEQ ID NO: 486 - DNA, 742 bp, Homo sapiens
  misc_feature (3)..(3): n is a, c, g, or t/u
  misc_feature (7)..(7): n is a, c, g, or t/u
  misc_feature (17)..(17): n is a, c, g, or t/u
  misc_feature (22)..(22): n is a, c, g, or t/u
  misc_feature (40)..(40): n is a, c, g, or t/u
  misc_feature (71)..(71): n is a, c, g, or t/u
  misc_feature (75)..(75): n is a, c, g, or t/u
  misc_feature (102)..(102): n is a, c, g, or t/u
  misc_feature (132)..(132): n is a, c, g, or t/u
  misc_feature (143)..(143): n is a, c, g, or t/u
  misc_feature (146)..(146): n is a, c, g, or t/u
  misc_feature (158)..(158): n is a, c, g, or t/u
  misc_feature (191)..(191): n is a, c, g, or t/u
  misc_feature (196)..(196): n is a, c, g, or t/u
  misc_feature (206)..(206): n is a, c, g, or t/u
  misc_feature (239)..(239): n is a, c, g, or t/u
  misc_feature (275)..(275): n is a, c, g, or t/u
  misc_feature (310)..(310): n is a, c, g, or t/u
  misc_feature (322)..(322): n is a, c, g, or t/u
  misc_feature (362)..(362): n is a, c, g, or t/u
  misc_feature (369)..(369): n is a, c, g, or t/u
  misc_feature (373)..(373): n is a, c, g, or t/u
  misc_feature (404)..(404): n is a, c, g, or t/u
  misc_feature (418)..(418): n is a, c, g, or t/u
  misc_feature (424)..(424): n is a, c, g, or t/u
  misc_feature (435)..(435): n is a, c, g, or t/u
  misc_feature (438)..(438): n is a, c, g, or t/u
  misc_feature (453)..(453): n is a, c, g, or t/u
  misc_feature (505)..(505): n is a, c, g, or t/u
  misc_feature (508)..(508): n is a, c, g, or t/u
  misc_feature (513)..(513): n is a, c, g, or t/u
  misc_feature (518)..(518): n is a, c, g, or t/u
  misc_feature (520)..(520): n is a, c, g, or t/u
  misc_feature (582)..(582): n is a, c, g, or t/u
  misc_feature (606)..(606): n is a, c, g, or t/u
  misc_feature (624)..(624): n is a, c, g, or t/u
  misc_feature (635)..(635): n is a, c, g, or t/u
  misc_feature (643)..(643): n is a, c, g, or t/u
  misc_feature (645)..(645): n is a, c, g, or t/u
  misc_feature (668)..(668): n is a, c, g, or t/u
  misc_feature (689)..(689): n is a, c, g, or t/u
  misc_feature (700)..(700): n is a, c, g, or t/u
  misc_feature (724)..(724): n is a, c, g, or t/u
ganacanagtctcactntgtcncccaggctggagtgcagnggcgagattcgtgaacaagtaattcttcacnctgntattttatgtctgtaggcttcaggaanaaatcatgaatttttcttctaaaataagtnttctgttgacncanactattggtaanattttcaacataaggggatgctaggactggccncctancatgagttgngagtaaagatctggtctgttgtttctccaaaanaagtttcttactgcttggctctcatgagttttctgnttctgctttctctttttcatattgatatatacggntttttaaatggntattggaattaaatatctcctcatttttctcttttagganatgatgntgcnttttcctctcaagaaaatgaatatcaattgntatcttgcttttgntggcanctttcttatgngcntgaactaattgctgntgaagccacatatttttgctttgtagttgaaataatttctgatctaaagacnccngctgntcagngngtttgttcacattatcttgttcgttttgatacatgtgttcagcttccttcatttgacactgngtttcacgttgggctctttgggcntgttctgaaaccaatgtnttttctcttanagcatctncngcataattgaaaataatttttangcttttggatttcctttggancttcaaaaagnggtgatgggacccctcattgggtntatatcggctactcacat

SEQ ID NO: 487 - DNA, 757 bp, Homo sapiens
ttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagccctcgtagtaacagccattctcatccaaaccccctgaagcttcaccggcgcagtcattctcataatcgcccacggacttacatcctcattactattctgcctagcaaactcaaactacgaacgcactcacagtcgcatcataatcctctctcaaggacttcaaactctactcccactaatagctttttgatgacttctagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacacaatggggctcactccccccacattaacaacataaaaccctcattcacacgagaaaacaccctcatgtcatacacctatccccattctctctattcctcaacccgaatattaccgggtttct

SEQ ID NO: 488 - DNA, 732 bp, Homo sapiens
  misc_feature (475)..(475): n is a, c, g, or t/u
  misc_feature (491)..(491): n is a, c, g, or t/u
  misc_feature (554)..(554): n is a, c, g, or t/u
  misc_feature (591)..(591): n is a, c, g, or t/u
  misc_feature (599)..(599): n is a, c, g, or t/u
  misc_feature (609)..(609): n is a, c, g, or t/u
  misc_feature (633)..(633): n is a, c, g, or t/u
  misc_feature (651)..(651): n is a, c, g, or t/u
  misc_feature (662)..(662): n is a, c, g, or t/u
  misc_feature (670)..(670): n is a, c, g, or t/u
  misc_feature (677)..(677): n is a, c, g, or t/u
  misc_feature (679)..(679): n is a, c, g, or t/u
  misc_feature (686)..(686): n is a, c, g, or t/u
  misc_feature (694)..(694): n is a, c, g, or t/u
  misc_feature (705)..(705): n is a, c, g, or t/u
  misc_feature (708)..(708): n is a, c, g, or t/u
aagaggaaaacccggtaatgatgtcggggttgagggataggaggagaatgggggataggtgtatgaacatgagggtgttttctcgtgtgaatgagggttttatgttgttaatgtggtgggtgagtgagccccattgtgttgtggtaaatatgtagagggagtatagggctgtgactagtatgttgagtcctgtaagtaggagagtgatatttgatcaggagaacgtggttactagcacagagagttctcccagtaggttaatagtggggggtaaggcgaggttagcgaggcttgctagaagtcatcaaaaagctattagtgggagtagagtttgaagtccttgagagaggattatgatgcgactgtgagtgcgttcgtagtttgagtttgctaggcagaatagtaatgaggatgtaagtccgtgggcgattatgagaatgactgcgccggtgaagcttcagggggtttggatganaatggctgttactacnagggctatgtggctgattgaagagtatgcaatgagcgattttaggtctgtttgtcgtaagcanatggagcttgttataattatgcctcatagggatagtncaaggaangggtaggctnttgttgtttgtccagggggttganaatgagtgtgaggcggtnttataccatanccgcctanttttaananatcttgnggcaagtncttttgacccnacnatgggggcttcacattggccttta

SEQ ID NO: 489 - DNA, 841 bp, Homo sapiens
  misc_feature (689)..(689): n is a, c, g, or t/u
  misc_feature (721)..(721): n is a, c, g, or t/u
  misc_feature (793)..(793): n is a, c, g, or t/u
aggagatccaccgcaagctctcagaggccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatcttcagcagctccttcaagttgttcttggagctggagccacangtccgagacatcatctttaaattctacgagtncaagtacgcctcatgtcttaagaatgctggaccaagaatgaaaggacaaccttgctccttggacattgtatnttgggcccccattgttaaggacccctgtacaccccaaatttccaaacc

SEQ ID NO: 490 - DNA, 583 bp, Homo sapiens
  misc_feature (490)..(490): n is a, c, g, or t/u
  misc_feature (500)..(500): n is a, c, g, or t/u
  misc_feature (545)..(545): n is a, c, g, or t/u
aggagatccaccgcaagctctcagaggccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgccgcaagcttggcaaaactggncgccaggaantacaaacaggcttgccaagtgctctgctggcttctttgatactgngacttcctgacttgttgtccccacaacgtggcatctac

SEQ ID NO: 491 - DNA, 707 bp, Homo sapiens
  misc_feature (504)..(504): n is a, c, g, or t/u
  misc_feature (538)..(538): n is a, c, g, or t/u
  misc_feature (541)..(541): n is a, c, g, or t/u
  misc_feature (576)..(576): n is a, c, g, or t/u
  misc_feature (621)..(621): n is a, c, g, or t/u
  misc_feature (628)..(628): n is a, c, g, or t/u
  misc_feature (659)..(659): n is a, c, g, or t/u
aacgctgagtctgctctttaatggacaccgcccacttgtctgcacctgactgaggcgggaacaggaggggtctgggaaatggtgccactgggcctgggtgccgcacagtctgctccctggggacagaaacccacagggtcgagccctgcaggcctctccttccaggaagggccacaactagcagccgcctgcctcctcagccccagggagggcacacaggctgggtggcacccagtggccaggccccttagctgggccgcaggcagcactgagccgcctggaggtccgaggtccgtggaggtggggagggggtgcaaatgtcctggaggccaaggttcacccctcacatgttggtgctcatccgggactggctgttggctggagtcagctccccctggctcccttctctgggcggggacttgacatggatctggttgcggagcacagctgcccgcagcatcatggccttggcgcggcgctggaactccttgcccatcaacaganacttctcaaaggtggtgctgcgctgatccacgtnccnggccgtataggatcttgcttgtgtgagtccacacnggcactgatcaaccccttcaagattaactgcgtcaactcgtcctncaaggcnggcaccgtggtatttgaaaggttgccccatnctatgcattgtcggcttgaaacgtaagggcttgaaatactggaatgaa

SEQ ID NO: 492 - DNA, 765 bp, Homo sapiens
  misc_feature (479)..(479): n is a, c, g, or t/u
  misc_feature (570)..(570): n is a, c, g, or t/u
  misc_feature (582)..(582): n is a, c, g, or t/u
  misc_feature (624)..(624): n is a, c, g, or t/u
  misc_feature (631)..(631): n is a, c, g, or t/u
  misc_feature (647)..(647): n is a, c, g, or t/u
  misc_feature (684)..(684): n is a, c, g, or t/u
  misc_feature (687)..(687): n is a, c, g, or t/u
  misc_feature (715)..(715): n is a, c, g, or t/u
  misc_feature (747)..(747): n is a, c, g, or t/u
gcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgccgcaggcttggcagagctggccgccaggaagtacaagcaggctgccaagtgcctcctgctggcttcctttgatcactgngacttccctgagctgctgtcccccaacaacgtggccatctacggtggcctgtgcgccttggctaccttttgaaccggcaggaacctgcaancgcaatgtcatnttccagcaacttcctttaagttgttcttggaacctggagccncaaggtnccaaaacattatcttnaaaattctaccaagttccaagtacccccttattgttnttnaaaaatgccttggaccgaaaaatgaaanggacaaacctggttccttgggaaaatgttttntttgggccccccattgtt

SEQ ID NO: 493 - DNA, 721 bp, Homo sapiens
  misc_feature (569)..(569): n is a, c, g, or t/u
  misc_feature (601)..(601): n is a, c, g, or t/u
  misc_feature (673)..(673): n is a, c, g, or t/u
ggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatcttcagcagctccttcaagttgttcttggagctggagccacangtccgagacatcatctttaaattctacgagtncaagtacgcctcatgtcttaagaatgctggaccaagaatgaaaggacaaccttgctccttggacattgtatnttgggcccccattgttaaggacccctgtacaccccaaatttccaaacc

SEQ ID NO: 494 - DNA, 550 bp, Homo sapiens
  misc_feature (443)..(443): n is a, c, g, or t/u
  misc_feature (449)..(449): n is a, c, g, or t/u
  misc_feature (451)..(451): n is a, c, g, or t/u
  misc_feature (455)..(455): n is a, c, g, or t/u
  misc_feature (458)..(458): n is a, c, g, or t/u
  misc_feature (469)..(469): n is a, c, g, or t/u
  misc_feature (473)..(474): n is a, c, g, or t/u
  misc_feature (479)..(479): n is a, c, g, or t/u
  misc_feature (497)..(497): n is a, c, g, or t/u
  misc_feature (502)..(502): n is a, c, g, or t/u
  misc_feature (509)..(509): n is a, c, g, or t/u
  misc_feature (515)..(515): n is a, c, g, or t/u
  misc_feature (521)..(521): n is a, c, g, or t/u
  misc_feature (526)..(526): n is a, c, g, or t/u
  misc_feature (535)..(535): n is a, c, g, or t/u
  misc_feature (537)..(537): n is a, c, g, or t/u
  misc_feature (548)..(548): n is a, c, g, or t/u
aacgctgagtctgctctttaatggacaccgcccacttgtctgcacctgactgaggcgggaacaggaggggtctgggaaatggtgccactgggcctgggtgccgcacagtctgctccctggggacagaaacccacagggtcgagccctgcaggcctctccttccaggaagggccacaactagcagccgcctgcctcctcagccccagggagggcacacaggctgggtggcacccagtggccaggccccttagctgggccgcaggcagcactgagccgcctggaggtccgaggtccgtggaggtggggagggggtgcaaatgtcctggaggccaaggttcacccctcacatgttggtgctcatccgggactggctgttggctggagtcagctccccctggctcccttctttgggcggggacttgacatggatcttggttgcggancacaantncccncancatcatggccntggnnccggngctggaactcttcccatnaacanaaacttnttaaangggggngctgngctgatccncnttccgggcctnta

SEQ ID NO: 495 - DNA, 738 bp, Homo sapiens
  misc_feature (572)..(572): n is a, c, g, or t/u
  misc_feature (602)..(602): n is a, c, g, or t/u
  misc_feature (622)..(622): n is a, c, g, or t/u
  misc_feature (659)..(659): n is a, c, g, or t/u
  misc_feature (673)..(673): n is a, c, g, or t/u
  misc_feature (690)..(690): n is a, c, g, or t/u
  misc_feature (723)..(723): n is a, c, g, or t/u
ggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatcttcagcagcttcttcaagttgttcttggagctggagccacaggtncgagacatcatctttaaattctacgaagtncaagtacccctcatgttttnaagatgcttggacgaaaatgaaaggacaaccttgctnctggacaatgtatnttggcccccattgttanggaccctgtacaacccaaaatttcgcaaccggngcccctcattcagtt

SEQ ID NO: 496 - DNA, 1082 bp, Homo sapiens
  misc_feature (991)..(991): n is a, c, g, or t/u
  misc_feature (1012)..(1012): n is a, c, g, or t/u
gccagattctgcacaagctccatttatcgttggttcttgcttttttccttctgtgtttttaattttttaaaaaacattgtatgttctagagaactagcttcacaaaaggtcggtggctgatgatctttcagctaagatttcaaatgtagaagaacaattcaaaatgctatcactgtgtatgtaagaaggatggggcagatttcattttaccctctagtctccctcaatgcatgcacggatttatctgtacgctaagctctctgctctgcatctgtagctccttgtggattatattgtctcagtgatcagaaatgattttctcggatatgaacaccgtttctggctcccctaaagtgcatcctcctaatgggacccggttttacacttttcaagaatttgctgcactgacaaaagaattaaatgcctgcagggaacaacttctagaaaaggaagaagaaatctctgaacttaaagctgaaagaaacaacacaagactattactggagcatttggagtgccttgtgtcacgacatgaaagatcactaagaatgacggtggtaaaacggcaagcccagtctccctcaggagtatccagtgaagttgaagttctcaaggcactgaaatctttgtttgagcaccacaaggccttggatgaaaaggtaagggagcgactgagggtttctttagaaagagtctctgcactggaagaagaactagctgctgctaatcaggagattgttgccttgcgtgaacaaaatgttcatatacaaagaaaaatggcatcaagcgagggatccacagagtcagaacatcttgaagggatggaacctggacagaaagtccatgagaagcgtttgtccaatggttctatagactcaaccgatgaaactagtcaaatagttgaactacaagaattgcttgaaaagcaaaaccaatgaaatggcccaaatgaaaaaacgtttaacagccctttctttccgagtggggagangtggacaaggaagccgagacngccaggaaaggatctctttaaacccgaagaaatggacccccagtttcaaagggacatttagggagggcct

SEQ ID NO: 497 - DNA, 673 bp, Homo sapiens
tatcactgagaacagatgggcaggtccacagcactgccagattctgcacaagctccatttatcgttggttcttgcttttttccttctgtgtttttaattttttaaaaaacattgtatgttctagagaactagcttcacaaaaggtcggtggctgatgatctttcagctaagatttcaaatgtagaagaacaattcaaaatgctatcactgtgtatgtaagaaggatggggcagatttcattttaccctctagtctccctcaatgcatgcacggatttatctgtacgctaagctctctgctctgcatctgtagctccttgtggattatattgtctcagtgatcagaaatgattttctcggatatgaacaccgtttctggctcccctaaagtgcatcctcctaatgggacccggttttacacttttcaagaatttgctgcactgacaaaagaattaaatgcctgcagggaacaacttctagaaaaggaagaagaaatctctgaacttaaagctgaaagaaacaacacaagactattactggagcatttggagtgccttgtgtcacgacatgaaagatcactaagaatgacggtggtaaaacggcaagcccagtctccctcaggagtatccaagtgaaagttgaagttctcaaggcactggaaatctttgttggac

SEQ ID NO: 498 - DNA, 796 bp, Homo sapiens
  misc_feature (17)..(17): n is a, c, g, or t/u
  misc_feature (21)..(21): n is a, c, g, or t/u
  misc_feature (23)..(23): n is a, c, g, or t/u
  misc_feature (43)..(43): n is a, c, g, or t/u
  misc_feature (93)..(93): n is a, c, g, or t/u
  misc_feature (126)..(126): n is a, c, g, or t/u
  misc_feature (163)..(163): n is a, c, g, or t/u
  misc_feature (363)..(363): n is a, c, g, or t/u
  misc_feature (373)..(373): n is a, c, g, or t/u
  misc_feature (532)..(532): n is a, c, g, or t/u
  misc_feature (562)..(562): n is a, c, g, or t/u
  misc_feature (568)..(568): n is a, c, g, or t/u
  misc_feature (602)..(602): n is a, c, g, or t/u
  misc_feature (606)..(606): n is a, c, g, or t/u
  misc_feature (612)..(612): n is a, c, g, or t/u
  misc_feature (638)..(638): n is a, c, g, or t/u
  misc_feature (643)..(643): n is a, c, g, or t/u
  misc_feature (670)..(670): n is a, c, g, or t/u
  misc_feature (677)..(677): n is a, c, g, or t/u
  misc_feature (695)..(695): n is a, c, g, or t/u
  misc_feature (698)..(698): n is a, c, g, or t/u
  misc_feature (704)..(704): n is a, c, g, or t/u
  misc_feature (709)..(709): n is a, c, g, or t/u
  misc_feature (724)..(724): n is a, c, g, or t/u
  misc_feature (736)..(736): n is a, c, g, or t/u
  misc_feature (747)..(747): n is a, c, g, or t/u
aaaccctgctcttgggngggngngggtataatactaagttganatgatatcatttacgggggaaggcgctttgtgaagtaggccttatttctnttgtcctttcgtacagggaggaatttgaagtanatagaaaccgacctggattactccggtctgaactcanatcacgtaggactttaatcgttgaacaaacgaacctttaatagcggctgcaccatcgggatgtcctgatccaacatcgaggtcgtaaaccctattgttgatatggactctaaaataggattgcgctgttatccctagggtaacttgttccgttggtcaagttattggatcaattgagtatagtagttcgctttgactggngaagtcttancatgtactgctcggaggttgggttctgctccgaggtcgccccaaccgaaatttttaatgcaggtttggtagtttaggacctgtgggtttgttaggtactgtttgcattaataaattaaagctccatagggcttctcgtcttgctgtgtcatgccccctnttacgggcaggcaatttcactgggtaaaantaaaanacagctgaaccctcgtggagccttcatacagggncctntttaangaacaagtgattttctcctttgcacnggtangggaccccggccgttaaacatgtgtantgggcangcgggcccttaatctggngangcctanaaggngatgtttttggtaanaagcgggggtanaatttgccgangtccctttacttttttaaccttccttttaacctcccgggttgggtgacc

SEQ ID NO: 499 - DNA, 776 bp, Homo sapiens
  misc_feature (685)..(685): n is a, c, g, or t/u
  misc_feature (706)..(706): n is a, c, g, or t/u
cagaaatgattttctcggatatgaacaccgtttctggctcccctaaagtgcatcctcctaatgggacccggttttacacttttcaagaatttgctgcactgacaaaagaattaaatgcctgcagggaacaacttctagaaaaggaagaagaaatctctgaacttaaagctgaaagaaacaacacaagactattactggagcatttggagtgccttgtgtcacgacatgaaagatcactaagaatgacggtggtaaaacggcaagcccagtctccctcaggagtatccagtgaagttgaagttctcaaggcactgaaatctttgtttgagcaccacaaggccttggatgaaaaggtaagggagcgactgagggtttctttagaaagagtctctgcactggaagaagaactagctgctgctaatcaggagattgttgccttgcgtgaacaaaatgttcatatacaaagaaaaatggcatcaagcgagggatccacagagtcagaacatcttgaagggatggaacctggacagaaagtccatgagaagcgtttgtccaatggttctatagactcaaccgatgaaactagtcaaatagttgaactacaagaattgcttgaaaagcaaaaccaatgaaatggcccaaatgaaaaaacgtttaacagccctttctttccgagtggggagangtggacaaggaagccgagacngccaggaaaggatctctttaaacccgaagaaatggacccccagtttcaaagggacatttagggagggcct

SEQ ID NO: 500 - DNA, 725 bp, Homo sapiens
  misc_feature (97)..(97): n is a, c, g, or t/u
  misc_feature (355)..(355): n is a, c, g, or t/u
  misc_feature (558)..(558): n is a, c, g, or t/u
  misc_feature (656)..(656): n is a, c, g, or t/u
  misc_feature (702)..(702): n is a, c, g, or t/u
atctacttatttttattaacctttaaaaaatatatataaagcacacattgatttcaatgtttactgtttgttacaagtgttttgggtccttacttanaagttcagtgatgtttctgtgaccagaaatacatcataggaatgtcactcttatttatgtcagttagcctatggtaaaagtggttttattatacgtctttcacttaagctcagttccaagacctattgaccacgttaagtaaggacttactacatactaagcatgaaaggagacaggttactgtcagagacaggagttacaaatgcaattgaccctcgaatgacatagtgtgaactgcatgggtgctcttgttagcanatatttttcaagaaatataaaaaaatttggacgccgggcacggtagctcacgcctgtaatcccagaactttgggaggccgaggcgggcggatcacgaggtcaggagatccagaccatcctggctaacacggtgaaaacccgtctctactaaaaatacaaaaaaaaaaataggtgggcgtggtggcaggcgcctgtagtcccanctactcgggaggctgtggcaggagaatggcgtgaacctgggaggcagagtttgcagtgagcccgagattgcgccctgcactccacctgagtgacaaancgagaatctggttggattggaatgatgtctgctgcatcatcagggnagatgggaatcctgggcaacttt

SEQ ID NO: 501 - DNA, 728 bp, Homo sapiens
  misc_feature (594)..(594): n is a, c, g, or t/u
  misc_feature (599)..(599): n is a, c, g, or t/u
  misc_feature (622)..(622): n is a, c, g, or t/u
  misc_feature (671)..(671): n is a, c, g, or t/u
  misc_feature (704)..(704): n is a, c, g, or t/u
gttggttcttgcttttttccttctgtgtttttaattttttaaaaaacattgtatgttctagagaactagcttcacaaaaggtcggtggctgatgatctttcagctaagatttcaaatgtagaagaacaattcaaaatgctatcactgtctccttgtggattatattgtctcagtgatcagaaatgattttctcggatatgaacaccgtttctggctcccctaaagtgcatcctcctaatgggacccggttttacacttttcaagaagcactgacaagatgtctggctttaacccatactgaggtggtatgaatgatttattcttccaggaatttgctgcactgacaaaagaattaaatgcctgcagggaacaacttctagaaaaggaagaagaaatctctgaacttaaagctgaaagaaacaacacaagactattactggagcatttggagtgccttgtgtcacgacatgaaagatcactaagaatgacggtggtaaaacggcaagcccagtctccctcaggagtatccagtgaagttgaagttctcaaggcactgaaatctttgtttgagcccacaaggccttggatgaaaangtaanggagcgactgagggtttctttanaaagaagtctctgcctggaagaaaaaactagctgctgctaatcaagganaatggttgccttgcgtgaaccaaaatgttcatntttccaaagaaaaatggcttcaag

SEQ ID NO: 502 - DNA, 722 bp, Homo sapiens
  misc_feature (57)..(57): n is a, c, g, or t/u
  misc_feature (276)..(276): n is a, c, g, or t/u
  misc_feature (615)..(615): n is a, c, g, or t/u
  misc_feature (624)..(624): n is a, c, g, or t/u
  misc_feature (640)..(640): n is a, c, g, or t/u
  misc_feature (691)..(691): n is a, c, g, or t/u
  misc_feature (705)..(705): n is a, c, g, or t/u
accaaacaaacgtcctattgaagacttgattcctttcttcttgggggctttgtgaanagagtcttggctgctgttggcactaccaagcccgaggctttctggctcaagagagacagataaactacttcgagcatcattgtggtaggaagaagggagagtgtgagtcattctgagggctctaggggtaggaggaggagaagtttcacatttaattgttgctttgtcctctcgaccatcttcttccacaactgcaatctttctccgatgtttcctcanatcacttggcagtgtcatgactcccatccgatccatttccctggcagggcttcgaggggtgagctttggagttgagtgtccactggggggagatgaactggccagcgatgaagctgtaacagaggcagtaatggaggtacctgggtggacccttgccaaattcaggccttcgaggctcacactagccactctattttcaatttcttcagcacgcaactctgtagattctttttcttcctgaattagcctgatttctttgttgatggcatccaattgttcctgaagcatcatggctagcgtctgggcatcggaatgaccacttggaagagagaagatccntttgagctnaaaattggttctctgncatcatcatcaatatcaagacatttcaatgtcacttttcaaaaaggggggnttgcttaatacctncaatctggtgaagttct

SEQ ID NO: 503 - DNA, 942 bp, Homo sapiens
  misc_feature (766)..(766): n is a, c, g, or t/u
  misc_feature (799)..(799): n is a, c, g, or t/u
  misc_feature (814)..(814): n is a, c, g, or t/u
  misc_feature (850)..(850): n is a, c, g, or t/u
  misc_feature (861)..(861): n is a, c, g, or t/u
  misc_feature (892)..(892): n is a, c, g, or t/u
  misc_feature (908)..(908): n is a, c, g, or t/u
  misc_feature (927)..(927): n is a, c, g, or t/u
gccagattctgcacaagctccatttatcgttggttcttgcttttttccttctgtgtttttaattttttaaaaaacattgtatgttctagagaactagcttcacaaaaggtcggtggctgatgatctttcagctaagatttcaaatgtagaagaacaattcaaaatgctatcactgtgtatgtaagaaggatggggcagatttcattttaccctctagtctccctcaatgcatgcacggatttatctgtacgctaagctctctgctctgcatctgtagctccttgtggattatattgtctcagtgatcagaaatgattttctcggatatgaacaccgtttctggctcccctaaagtgcatcctcctaatgggacccggttttacacttttcaagaatttgctgcactgacaaaagaattaaatgcctgcagggaacaacttctagaaaaggaagaagaaatctctgaacttaaagctgaaagaaacaacacaagactattactggagcatttggagtgccttgtgtcacgacatgaaagatcactaagaatgacggtggtaaaacggcaagcccagtctccctcaggagtatccagtgaagttgaagttctcaaggcactgaaatctttgtttgagcacccaaggccttggatgaaaaggtaagggagcgactggagggtttctttagaaagagtctctgcctggaagaaaactagctgctgctaatcaggagatggtggccttgcgtgaaccaaaatgttcatatncaaagaaaaatggcttcaagccgagggatcccncagagtcagaacatntttgaagggatggaacccgggacagaaagtccttgnaaaagcgttgntccaatgggttttttagacctcacccgatgnaaactggtccaatagntggacttccaagaaatggntggaaaagccaaact

SEQ ID NO: 504 - DNA, 717 bp, Homo sapiens
  misc_feature (581)..(581): n is a, c, g, or t/u
  misc_feature (585)..(585): n is a, c, g, or t/u
  misc_feature (614)..(614): n is a, c, g, or t/u
  misc_feature (646)..(646): n is a, c, g, or t/u
  misc_feature (658)..(658): n is a, c, g, or t/u
  misc_feature (660)..(660): n is a, c, g, or t/u
  misc_feature (670)..(670): n is a, c, g, or t/u
  misc_feature (686)..(686): n is a, c, g, or t/u
  misc_feature (695)..(695): n is a, c, g, or t/u
gagatgtgaacctttcaccatgaaaatgttaaaagatataaaggaaggagttaaacaatatggatccaactccccttatataagaacattattagattccattgctcatggaaatagacttactccttatgactgggaaattttggccaaatcttccctttcatcctctcagtatctacagtttaaaacctggtggattgatggagtacaagaacaggtacgaaaaaatcaggctactaagcccactgttaatatagacgcagaccaattgttaggaacaggtccaaattggagcaccattaaccaacaatcagtgatgcagaatgaggctattgaacaagtaagggctatttgcctcagggcctggggaaaaattcaggacccaggaacagctttccctattaattcaattagacaaggctctaaagagccatatcctgctttgtggcaagattacaagatgctgctcaaaagtctattacagatgacaatgcccgaaaagttattgtagaattaatggcctatgaaaatgcaaatccagaatgtcagtccggcataaagccattaaaagggaaagttcnacangagttgatgtattacagaatatgtgaagntttgtatgagattggaggagctatgcttaagnaatgcttatggntnaagccatganggggctcactctagangacaagtanaaatttgggaaaaaatggttta

SEQ ID NO: 505 - DNA, 758 bp, Homo sapiens
  misc_feature (107)..(107): n is a, c, g, or t/u
  misc_feature (505)..(505): n is a, c, g, or t/u
  misc_feature (552)..(552): n is a, c, g, or t/u
  misc_feature (585)..(585): n is a, c, g, or t/u
  misc_feature (589)..(589): n is a, c, g, or t/u
  misc_feature (595)..(595): n is a, c, g, or t/u
  misc_feature (616)..(616): n is a, c, g, or t/u
  misc_feature (633)..(633): n is a, c, g, or t/u
  misc_feature (649)..(649): n is a, c, g, or t/u
  misc_feature (653)..(653): n is a, c, g, or t/u
gtttaaccaattgagctttgagtgttctattagttctttcaattatggcctgtccttgggaattatagagaattcctattgtatgtgtaattttccactgatttaanaatttttgaaatgctttactacagtaacctggcccattgtctgttttaactttttctggaactcccatgacaggaaaacaagataataaatgtcttttaacatgggaagtactttctcctgtctggcaggttgcccatatgaaatgtgaataagtatcaactgtcacatggacaaatgacaattttccaaatgaaggtacgtgcatgacatccatttgccataacacattaggacatagacctctgggattaactcttgcctcctgagtggccaggtgtagaatctgacactgggtgcaatgttgtacaatattttttggctgtttccatgtgatatcaaatttattttttaatcctattgcatttacatgagtcaaggcatgaagttcttgtgcttncatgaatgcagatgatactagcaagtcagcttggtcatttgctttanttaaaggcccctggtaaattaagtgtggctccnaatntgagtnatataaaatggggaaatttcnttttcttacattttggnggaaccaaattaaacnagcngggtttaaccggatcatccattaatggattttggattaagggcttttctcaaatattcctttgggagcccggtacctacattatgccaaaaatctggataccaat

SEQ ID NO: 506 - DNA, 748 bp, Homo sapiens
  misc_feature (567)..(567): n is a, c, g, or t/u
  misc_feature (579)..(579): n is a, c, g, or t/u
  misc_feature (636)..(636): n is a, c, g, or t/u
  misc_feature (644)..(644): n is a, c, g, or t/u
  misc_feature (672)..(672): n is a, c, g, or t/u
  misc_feature (697)..(697): n is a, c, g, or t/u
  misc_feature (701)..(701): n is a, c, g, or t/u
  misc_feature (715)..(715): n is a, c, g, or t/u
  misc_feature (725)..(725): n is a, c, g, or t/u
agcaacccacagcgatggcgtctaattcaccagcaacacaggacgcggcgctgtatcctcagccgcccactgtgagacttaatcctacagcatcacgtagtggacagggtggtgcactgcatgcagtcattgatgaagccagaaaacagggcgatcttgaggcatggcggttcctggtaattttacaactggtacaggccggggaagagactcaagtaggagcgcctgcccgagctgagactagatgtgaacctttcaccatgaaaatgttaaaagatataaaggaaggagttaaacaatatggatccaactccccttatataagaacattattagattccattgctcatggaaatagacttactccttatgactgggaaattttggccaaatcttcctttcatcctctcagtatctacagtttaaaacctggtggattgatggagtacaaagaacaggtacgaaaaaatcaggctactaacccctgttatatagacgcagaccaattgttaggaacaggtcaaattggagcccattaaccaacaatcatgatgcaaaatgaggctnttgacaagtaanggcttttgcctcaaggcctggggaaaaatcaggaccaagaacagtttccttttattnattagacnagggtttaaaagcatttctgctttgtgngagaatacaaaagctggtcaaaatntttncaatgaaatgcccnaaagtttggnaattatggctttgaaatccaatc

SEQ ID NO: 507 - DNA, 742 bp, Homo sapiens
  misc_feature (558)..(558): n is a, c, g, or t/u
  misc_feature (576)..(576): n is a, c, g, or t/u
  misc_feature (578)..(578): n is a, c, g, or t/u
  misc_feature (631)..(631): n is a, c, g, or t/u
  misc_feature (669)..(669): n is a, c, g, or t/u
  misc_feature (684)..(684): n is a, c, g, or t/u
  misc_feature (687)..(687): n is a, c, g, or t/u
  misc_feature (702)..(702): n is a, c, g, or t/u
gtttaaccaattgagctttgagtgttctattagttctttcaattatggcctgtccttgggaattatagagaattcctattgtatgtgtaattttccactgatttaagaatttttgaaatgctttactacagtaacctggcccattgtctgttttaactttttctggaactcccatgacaggaaaacaagataataaatgtcttttaacatgggaagtactttctcctgtctggcaggttgcccatatgaaatgtgaataagtatcaactgtcacatggacaaatgacaattttccaaatgaaggtaccgtgcatgacatccatttgccataacacattaggacatagacctctgggattaactcttgcctcctgagtggccaggtgtagaatctgacactgggtgcaatgttgtacaatattttttgtctgtttccatgtgatatcaaatttattttttaatcctattgcatttacatgagtcaaggcatgaagttcttgtgcttccatgaatgcagatgatctagcaagtcagcttggtcatttgctttaattaaangccctggtaaattagtgngngctcgaatatgagtaatataaaatgggaaatttctttttcttacattttgggnggaaccaaaataaacaagcgggggttaactggatcatncataatggatttgantanggctctctcaatatnccttggaacccggtcctacatttgcagaatctggatccat

SEQ ID NO: 508 - DNA, 718 bp, Homo sapiens
agtgtggtcattgaggacaagttgacgagagagtcccaagtacgtccacggtcagccttgcggtaagcttgtgtgcttagaggaacccagggtaacgatggggcaaactgaaagtaaatatgcctcttatctcagctttattaaaattcttttaagaagagggggagttagagcttctacagaaaatctaattacgctatttcaaacaatagaacaattctgcccatggtttccagaacagggaactttagatctaaaagattgggaaaaaattggcaaagaattaaaacaagcaaatagggaaggtaaaatcatcccacttacagtatggaatgattgggccattattaaagcaactttagaaccatttcaaacaggagaagatattgtttcagtttctgatgcccctaaaagctgtgtaacagattgtgaagaagaggcagggacagaatcccagcaaggaacggaaagttcacattgtaaatatgtagcagagtctgtaatggctcagtcaacgcaaaatgttgactacagtcaattacaggagataatataccctgaatcatcaaaattgggggaaggaggtccagaatcattggggccatcagagcctaaaccacgatcgccatcaactcctccttccgcggttcaaatgcctgtacattcaacctcaaaccgcaggttagacaagcccaaacccccaagagaaaatcaagtt

SEQ ID NO: 509 - DNA, 725 bp, Homo sapiens
  misc_feature (205)..(205): n is a, c, g, or t/u
  misc_feature (580)..(580): n is a, c, g, or t/u
  misc_feature (639)..(639): n is a, c, g, or t/u
  misc_feature (686)..(686): n is a, c, g, or t/u
gatttttttcagcctcaattgggacttctttcctagtccctttttagggagctatcccattttggtcatgatttttttattcctggggctgtatatggaggctgggatagtaatctctgcatgccattgttgtaacaagtctcggccccataaattgattggaatgaagtgatcacaggctgaaccgtactttcttgattatcanatcctggacaatgtaaaatcatggcactttgatacacttctgaggcagtacctatgccgatgacagaaacatcagcctgggtatccactaatccttcaaactctttccctgaatagtgactgtacacacgggtctatcctctgagacctgattagcccaataagcagcttttcctgcagggttggtacttccaaaccctcctgttctttcctttttgttttccccaattttaacataaggcaaaagcagtaattgagcaattctatcacctggattggcactccggggaacagtggagctgatcactaactgaattccccctttataatctgagtaaattaccccagtatgaatttggactcccttcaaatttanacttgatctccctcaaaggcctaccctcccttctggcagcgggccatatacccctctangaatcttttgtgggggctttcccaggagtaaaaagaccatttggggnggaacataaatctactgcgggctgcctgctggggcccgg

SEQ ID NO: 510 - DNA, 998 bp, Homo sapiens
ggaagagggaagtcgtggtggtcgcgagggagccggaaagatggtggttaccagatctgcacgggctaaggccagcatccaagccgcgtcggctgaaagttccgggcaaaagagttttgctgctaatgggattcaagcgcatccagaaagtagtactggatctgatgcccgaactactgctgaatcacagaccactgggaagcaaagtttaatccctagaactcctaaagctagaaagaggaagagcagaactacaggctcactaccaaaggggactgaaccatctacggatggagaaacctctgaggcagagtcaaattattctgtgtctgagcaccatgataccattttaagggtaactaggagaaggcagatcttaattgcatgctccccagtgtccagtgttaggaaaaagccgaaagtaactccaacaaaggagtcttacactgaagaaatagtgtctgaagcagaatctcatgtttcaggtatttctagaattgtgcttcctacagaaaaaactacaggagccagaagaagtaaggctaaatctctgacagatccaagccaagaatctcatacagaagctatatctgatgctgagacatcaagctcagacatttcattctctggaattgcaactagaagaaccaggagtatgcagaggaaattaaaggcacaaactgaaaagaaagatagtaagattgtaccaggaaatgagaaacagatcgtgggtacacctgtgaattcagaggattcagataccagacaaacttcccatttacaagcaagatctctttctgagataaataagccaaatttctataataatgactttgatgatgatttctcccacagaagttcagaaaatatattaacagtgcaccgaacaggccaatgttgaatctcttaaagaaacaaaacagaattgtaaggatttggatgaagatgccaatggaataacagatgaggggaaagaaattaatgagaaaagttcttca

SEQ ID NO: 511 - DNA, 623 bp, Homo sapiens
  misc_feature (455)..(455): n is a, c, g, or t/u
  misc_feature (497)..(497): n is a, c, g, or t/u
  misc_feature (613)..(613): n is a, c, g, or t/u
gttaccagatctgcacgggctaaggccagcatccaagccgcgtcggctgaaagttccgggcaaaagagttttgctgctaatgggattcaagcgcatccagaaagtagtactggatctgatgcccgaactactgctgaatcacagaccactgggaagcaaagtttaatccctagaactcctaaagctagaaagaggaagagcagaactacaggctcactaccaaaggggactgaaccatctacggatggagaaacctctgaggcagagtcaaattattctgtgtctgagcaccatgataccattttaagggtaactaggagaaggcagatcttaattgcatgctccccagtgtccagtgttaggaaaaagccgaaagtaactccaacaaaggagtcttacactgaagaaatagtgtctgaagcagaatctcatgtttcaggtatttctagaattgngcttcctacagaaaaaactacaggagccagaagaagtaaggntaaatctcttgacagatccaaccaagaatctcataccagaaactatatctgatgctgagacatcaaagctcaaacatttcatttctcttggaattgccacctagaagaaccaaganttttgcccga

SEQ ID NO: 512 - DNA, 655 bp, Homo sapiens
  misc_feature (3)..(3): n is a, c, g, or t/u
  misc_feature (145)..(145): n is a, c, g, or t/u
  misc_feature (176)..(176): n is a, c, g, or t/u
  misc_feature (229)..(229): n is a, c, g, or t/u
  misc_feature (241)..(241): n is a, c, g, or t/u
  misc_feature (314)..(314): n is a, c, g, or t/u
  misc_feature (351)..(351): n is a, c, g, or t/u
  misc_feature (360)..(360): n is a, c, g, or t/u
  misc_feature (420)..(420): n is a, c, g, or t/u
  misc_feature (433)..(433): n is a, c, g, or t/u
  misc_feature (462)..(462): n is a, c, g, or t/u
  misc_feature (481)..(481): n is a, c, g, or t/u
  misc_feature (531)..(531): n is a, c, g, or t/u
  misc_feature (551)..(551): n is a, c, g, or t/u
  misc_feature (558)..(558): n is a, c, g, or t/u
  misc_feature (562)..(562): n is a, c, g, or t/u
  misc_feature (567)..(567): n is a, c, g, or t/u
  misc_feature (586)..(586): n is a, c, g, or t/u
  misc_feature (598)..(598): n is a, c, g, or t/u
  misc_feature (628)..(628): n is a, c, g, or t/u
agntttccaaacgtctttaataagtaaataaaggagcaatgtaaaatgttgcagtttgcttggtaaatcttaattgcgaaatttcttcttctttcggaacttttttcctgctgcatttgctgctttttcagccatgatctctgantacttccttcggttgtatcttctgaattcanaatcagccagcagttcttccacaatagttcttttcctttgcttcttgggaatncgtgaatggtanaaatcagctggattgtcaacaatggttccaatctggaagtacttggggaagccatctctatcatttttcttgnaaaatcttttcgggtccatgctggctctcatcttcantgctttganatcatttttcagttcatttgtcatttctggagctttcataccaaaccagccatcccctgntggtttttggcgntcttttctgcgttttttctgaagttgatnctttgattcactatatggnggaacacagtggtttttttcaaaatcaggtgtaatgacggctttctgcanaaactcatttttctttttcnccttganctgngttanggttctcttgttaaactgnaatttatctgcnttaaaattaatatacaaaccacccaactgnttgatccttaaaccaagggctatgctg

SEQ ID NO: 513 - DNA, 666 bp, Homo sapiens
cgagccatgataccattttaagggtaactaggagaaggcagatcttaattgcatgctccccagtgtccagtgttaggaaaaagccgaaagtaactccaacaaaggagtcttacactgaagaaatagtgtctgaagcagaatctcatgtttcaggtatttctagaattgtgcttcctacagaaaaaactacaggagccagaagaagtaaggctaaatctctgacagatccaagccaagaatctcatacagaagctatatctgatgctgagacatcaagctcagacatttcattctctggaattgcaactagaagaaccaggagtatgcagaggaaattaaaggcacaaactgaaaagaaagatagtaagattgtaccaggaaatgagaaacagatcgtgggtacacctgtgaattcagaggattcagataccagacaaacttcccatttacaagcaagatctctttctgagataaataagccaaatttctataataatgactttgatgatgatttctcccacagaagttcagaaaatatattaacagtgcaccgaacaggccaatgttgaatctcttaaagaaacaaaacagaattgtaaggatttggatgaagatgccaatggaataacagatgaggggaaagaaattaatgagaaaagttcttca

SEQ ID NO: 514 - DNA, 699 bp, Homo sapiens
  misc_feature (403)..(403): n is a, c, g, or t/u
  misc_feature (458)..(458): n is a, c, g, or t/u
  misc_feature (473)..(473): n is a, c, g, or t/u
  misc_feature (485)..(485): n is a, c, g, or t/u
  misc_feature (501)..(501): n is a, c, g, or t/u
  misc_feature (512)..(512): n is a, c, g, or t/u
  misc_feature (533)..(533): n is a, c, g, or t/u
  misc_feature (557)..(557): n is a, c, g, or t/u
  misc_feature (621)..(621): n is a, c, g, or t/u
  misc_feature (645)..(645): n is a, c, g, or t/u
  misc_feature (657)..(657): n is a, c, g, or t/u
  misc_feature (661)..(661): n is a, c, g, or t/u
ggaagagggaagtcgtggtggtcgcgagggagccggaaagatggtggttaccagatctgcacgggctaaggccagcatccaagccgcgtcggctgaaagttccgggcaaaagagttttgctgctaatgggattcaagcgcatccagaaagtagtactggatctgatgcccgaactactgctgaatcacagaccactgggaagcaaagtttaatccctagaactcctaaagctagaaagaggaagagcagaactacaggctcactaccaaaggggactgaaccatctacggatggagaaacctctgaggcagagtcaaattattctgtgtctgagcaccatgataccattttaagggtaactaggagaaggcagatcttaattgcatgctccccagtgtccagngttaggaaaaagccgaaagtaactccaacaaaggagtcttacactgaagaaatantgtctgaagcaaaanctcatgtttcangtatttctagaattgngcttcctacanaaaaaactacaggagccagancaagtaaggctaaatctctgacanatccaagccaagaatctcatacagaagctatatctgatgcttgaacatcaagctcagacatttnattctctggaattgcaactagaanaaccaggaattntgcngagggaaatttaagggccccaactggaaaagaaaggat

SEQ ID NO: 515 - DNA, 759 bp, Homo sapiens
  misc_feature (257)..(257): n is a, c, g, or t/u
  misc_feature (314)..(314): n is a, c, g, or t/u
  misc_feature (480)..(480): n is a, c, g, or t/u
  misc_feature (508)..(508): n is a, c, g, or t/u
  misc_feature (510)..(510): n is a, c, g, or t/u
  misc_feature (520)..(520): n is a, c, g, or t/u
  misc_feature (531)..(531): n is a, c, g, or t/u
  misc_feature (554)..(554): n is a, c, g, or t/u
  misc_feature (565)..(565): n is a, c, g, or t/u
  misc_feature (569)..(569): n is a, c, g, or t/u
  misc_feature (581)..(581): n is a, c, g, or t/u
  misc_feature (601)..(601): n is a, c, g, or t/u
  misc_feature (625)..(625): n is a, c, g, or t/u
  misc_feature (634)..(634): n is a, c, g, or t/u
  misc_feature (638)..(638): n is a, c, g, or t/u
  misc_feature (640)..(641): n is a, c, g, or t/u
  misc_feature (651)..(651): n is a, c, g, or t/u
  misc_feature (656)..(656): n is a, c, g, or t/u
  misc_feature (675)..(675): n is a, c, g, or t/u
  misc_feature (701)..(701): n is a, c, g, or t/u
  misc_feature (706)..(706): n is a, c, g, or t/u
  misc_feature (719)..(719): n is a, c, g, or t/u
  misc_feature (738)..(738): n is a, c, g, or t/u
  misc_feature (743)..(743): n is a, c, g, or t/u
  misc_feature (750)..(750): n is a, c, g, or t/u
agttttccaaacgtctttaataagtaaataaaggagcaatgtaaaatgttgcagtttgcttggtaaatcttaattgcgaaatttcttcttctttcggaacttttttcctgctgcatttgctgctttttcagccatgatctctgagtacttccttcggttgtatcttctgaattcagaatcagccagcagttcttccacaatagttcttttcctttgcttcttgggaattcgtgaatggtagaaatcagctggattgncaacaatggttccaatctggaagtacttggggaagccatctctatcatttttcttgnaaaatcttttcgggtccatgctggctctcatcttcagtgctttgagatcatttttcagttcatttgtcatttctggagctttcataccaaaccagccatcccctgctgttttttgtcgttcttttctgcgttttttctgaagttgatctttgattcactatatggnggaacacagtggtttttttcaaaatcangngtaatggacngctttctgcanaagcccatttttctttttctccntggatctgggntaangggtcctcttgntagaactgggagtttatctnccttaaaaattaatatacaaaccnccccactgnttgntnnctcaaaaacnagggnctattcctgttgcttgtcnaccttcaaaaagtttaacccctttgngcctntttaaggaaagcntttttattactaaactcanctttnattttcngcatggggc

SEQ ID NO: 516 - DNA, 1072 bp, Homo sapiens
  misc_feature (836)..(836): n is a, c, g, or t/u
  misc_feature (863)..(863): n is a, c, g, or t/u
  misc_feature (880)..(880): n is a, c, g, or t/u
  misc_feature (914)..(914): n is a, c, g, or t/u
  misc_feature (926)..(926): n is a, c, g, or t/u
  misc_feature (955)..(955): n is a, c, g, or t/u
  misc_feature (973)..(973): n is a, c, g, or t/u
  misc_feature (1003)..(1003): n is a, c, g, or t/u
  misc_feature (1025)..(1025): n is a, c, g, or t/u
  misc_feature (1038)..(1038): n is a, c, g, or t/u
  misc_feature (1052)..(1052): n is a, c, g, or t/u
gtgacgacatagaacaggagacctttatgcttgatgagccattagaaagaaccacaaatagctcccatgccaatggtgctgcccaagctccccgttcaatgcagtgggctgtccgcaacacccagcatcagcgagcagccagtacagccccttccagtacatctacaccagcagcaagttcagcgggtttgatttatattgatccttcaaacttacgccggagtggtaccatcagtacaagtgctgcagctgcagcagctgctttggaagctagcaacgccagcagttacctaacatctgcaagcagtttagccagggcttacagcattgtcattagacaaatctcggacttgatgggccttattcctaagtataatcacctagtatactctcagattccagcagctgtgaaattgcttaccaagatgcagtaaacttacagaactatgtagaagaaaagctcattcccacttggaactggatggtcagtattatggattctactgaagctcaattacgttatggttctgcattagcatctgctggtgatcctggacatccaaatcatcctcttcacgcttctcagaattcagcgagaagagagaggatgactgcgcgagaagaagctagcttacgaacacttgaaggcagacgacgtgccaccttgcttagcgcccgtcaaggaatgatgtctgcacgaggagacttcctaaattatgctctgctctaatgcggctcataatgatgagcattctgatgttcttccagttttggatgtttgctcattgaagcatgtggcatatgtttttcaaagcacttatatactggattaaggnaatgaatcagcagacacatttggatcnccctcaactagaacccnaaaggacgcgagaactcttgggactgggttttgntatgaaattcanaacatgaaatgatgatgacaccatcaaangcttctttgatgataagntgatgactctttctgcgaactggccaaacnatcatttttccacgtcaactcntgcattccttggnggttcccccaatcncttgaaggccctggtgaaac

SEQ ID NO: 517 - DNA, 767 bp, Homo sapiens
  misc_feature (531)..(531): n is a, c, g, or t/u
  misc_feature (558)..(558): n is a, c, g, or t/u
  misc_feature (575)..(575): n is a, c, g, or t/u
  misc_feature (609)..(609): n is a, c, g, or t/u
  misc_feature (621)..(621): n is a, c, g, or t/u
  misc_feature (650)..(650): n is a, c, g, or t/u
  misc_feature (668)..(668): n is a, c, g, or t/u
  misc_feature (698)..(698): n is a, c, g, or t/u
  misc_feature (720)..(720): n is a, c, g, or t/u
  misc_feature (733)..(733): n is a, c, g, or t/u
  misc_feature (747)..(747): n is a, c, g, or t/u
gtttagccagggcttacagcattgtcattagacaaatctcggacttgatgggccttattcctaagtataatcacctagtatactctcagattccagcagctgtgaaattgacttaccaagatgcagtaaacttacagaactatgtagaagaaaagctcattcccacttggaactggatggtcagtattatggattctactgaagctcaattacgttatggttctgcattagcatctgctggtgatcctggacatccaaatcatcctcttcacgcttctcagaattcagcgagaagagagaggatgactgcgcgagaagaagctagcttacgaacacttgaaggcagacgacgtgccaccttgcttagcgcccgtcaaggaatgatgtctgcacgaggagacttcctaaattatgctctgctctaatgcggctcataatgatgagcattctgatgttcttccagttttggatgtttgctcattgaagcatgtggcatatgtttttcaaagcacttatatactggattaaggnaatgaatcagcagacacatttggatcnccctcaactagaacccnaaaggacgcgagaactcttgggactgggttttgntatgaaattcanaacatgaaatgatgatgacaccatcaaangcttctttgatgataagntgatgactctttctgcgaactggccaaacnatcatttttccacgtcaactcntgcattccttggnggttcccccaatcncttgaaggccctggtgaaac

SEQ ID NO: 518 - DNA, 765 bp, Homo sapiens
  misc_feature (260)..(260): n is a, c, g, or t/u
  misc_feature (611)..(611): n is a, c, g, or t/u
  misc_feature (687)..(687): n is a, c, g, or t/u
  misc_feature (742)..(742): n is a, c, g, or t/u
attttacatgtctttattttacatttagaaccgttttatgatttacttaaaaaaaaaatcttttactattattagaagtattttttaaccaaaatcttgatttaggaagacttaagacattgtgcattattttaaatattttcatttcagtaactattaaaaataaattcacaattagggtttcaaatgtcctaatcatatctagtttgttctcatttaatattttatcaatcccatcatgtgcatacagaggttaaggngatgtataaattttatatctttcaaacacattgatgctaatcagctcttgatctaattactatttcatttattcagaaatagcatttagacataaaaaccaatgtctcactttgtaaaataacctttggctaatttacacacatctaatacagcgtgttatataagttttaagtaatacaatgagtcactactatcattcagttttaaatatttttagtgttaacagggctgagaatatcatgtggttcagtcttctgaaggaagttatataataaaagcatagtgcctttgaacatgaagactatcctcaaggccagaaatcctacaaagggaactgaaaggagagattncagagaattgctctcctcatttttaatatgtaaagggactggtttaagtcacttcattggaagactttaaggaaanaaaacaggggtattttgcccctggataaagctaccttaaacccaaaggaattttnggggatattaatccctaggcttc

SEQ ID NO: 519 - DNA, 571 bp, Homo sapiens
  misc_feature (488)..(488): n is a, c, g, or t/u
  misc_feature (508)..(508): n is a, c, g, or t/u
  misc_feature (512)..(512): n is a, c, g, or t/u
  misc_feature (534)..(534): n is a, c, g, or t/u
  misc_feature (538)..(538): n is a, c, g, or t/u
  misc_feature (546)..(546): n is a, c, g, or t/u
  misc_feature (548)..(548): n is a, c, g, or t/u
  misc_feature (559)..(559): n is a, c, g, or t/u
gtgacgacatagaacaggagacctttatgcttgatgagccattagaaagaaccacaaatagctcccatgccaatggtgctgcccaagctccccgttcaatgcagtgggctgtccgcaacacccagcatcagcgagcagccagtacagccccttccagtacatctacaccagcagcaagttcagcgggtttgatttatattgatccttcaaacttacgccggagtggtaccatcagtacaagtgctgcagctgcagcagctgctttggaagctagcaacgccagcagttacctaacatctgcaagcagtttagccagggcttacagcattgtcattagacaaatctcggacttgatgggccttattcctaagtataatcacctagtatactctcagattccagcagctgtgaaattgcttaccaagatgcagtaaacttacagaactatgtagaaaaaaagcttattcccttggaactggatgggcagnattatggattctctgaagcncaantccctatgggtctgcatttcanctgntggggaancnggaattcaaanattctctttcgc

SEQ ID NO: 520 - DNA, 681 bp, Homo sapiens
  misc_feature (183)..(183): n is a, c, g, or t/u
  misc_feature (621)..(621): n is a, c, g, or t/u
  misc_feature (629)..(629): n is a, c, g, or t/u
  misc_feature (657)..(657): n is a, c, g, or t/u
catacttaattttttattttgaaattccctattccctctatacaagaacctttgctgaaacagtttccacaaaggcagcagtgaattttcagaacatttacattttttccccctcagcaaaaagataaatcacagtgtaaattatgttgttctgctgtcatctttggctggggttagacccanaagttggtgactagcaaaccaatatagccaaatgttgctagtgctccttaggcctttaagctataaactcagcaaggaatgtctgcattttatctctttaaggtaccaccaggggggtatgacagcattaacttccataaacttttatagacaaatggaaaaaaatctacaaaatttgctagtaatattacacagcaatacacactttttatactctacacaaaaccaaaattcttggtcttaatggcgagtaacaatttctgtttgagaatctgtttagaggaatagagtgggacgtaaagtcgagaaatgcaagtatttgcagtaggaagatgttggtcatctggtggtcttattgtgattgagggcataggctggaatccttcttcactggctggcaatgatgggcttgatgtccaaaagtaaacaagatcttgncggtctgncatgctcatcttctctactattgaccanaaccaacgcttgaactggaaaaac

SEQ ID NO: 521 - DNA, 1890 bp, Homo sapiens
  misc_feature (1281)..(1281): n is a, c, g, or t/u
  misc_feature (1288)..(1288): n is a, c, g, or t/u
  misc_feature (1519)..(1519): n is a, c, g, or t/u
  misc_feature (1650)..(1650): n is a, c, g, or t/u
  misc_feature (1691)..(1691): n is a, c, g, or t/u
gcgggttccagttgtgattgctggagttgtgtattgccaggaggctctccgagattggggtcgggtcactgcctcatccaccggagcgatggcgtttctccgaagcatgtggggcgtgctgagtgccctgggaaggtctggagcagagctgtgcaccggctgtggaagtcgactgcgctcccccttcagttttgtgtatttaccgaggtggttttcatctgtcttggcaagttgtccaaagaaacctgtaagttcttaccttcgattttctaaagaacaactacccatatttaaagctcagaacccagatgcaaaaactacagaactaattagaagaattgcccagcgttggagggaacttcctgattcaaagaaaaaaatatatcaagatgcttatagggcggagtggcaggtatataaagaagagataagcagatttaaagaacagctaactccaagtcagattatgtctttggaaaaagaaatcatggacaaacatttaaaaaggaaagctatgacaaaaaaaaaagagttaacactgcttggaaaaccaaaaagacctcgttcagcttataaccgtttatgtagctgaaagattccaagaagctaagggtgattcacccgcaggaaaagctgaagactgtaaaggaaaactggaaaaatctgtctgactctgaaaaggaattatatattcagcatgctaaagaggacgaaactcgttatcataatgaaatgaagtcttgggaagaacaaatgattgaagttggacgaaaggatcttctacgtcgcacaataaagaaacaacgaaaatatggtgctgaggagtgttaaaagtagaagattgagatgtgttcacaatggataggcacaggaaaccagttaggtctcaatacctgaagctatcgtaaaattaagaaaggataaagttggtaaaccttttatatttagtatctttttattcagctcatggacttctgccagcataatacttgctttggaaaacccagataaaggttcatgcaaactttattttgtgtttaggaactactgaggatcagagtaatccaagcaaatgtgaatcattttacctttgacaaaggtaaatcagactatgaagttttttttatacaggatgatgactatggaaagagtactcttgtttccttatattatggaggcaggagtttcgttttcaaaattgttcaaattgtagaaaccacggggtctgtgatataagtgtgtgtttttcataaagcaggcagaactcatttaggtaaattncagttcntaggtataattcacattgtattcagagttgatggttgacatataagtgattgctggttttagttgcaactttgtataaaagggactgagaaatttataaacttttttcttactgtcttttttctaaagtaaaaacaaagaaattatgtgccagatttatgcatattattttatgttgcatagaataaaatttttaatctttaattttacatttcctaaatatattttaagncgaaacatttgttctatagcttttccctttttttaagtaaggaattttatttttttctgaattattttctctcgtgagtatattgatccagaaagaaaacttgtattatgtgtgttttaaaatgagaaatntaaaaaacgaaaagtctccaaagtctctggaatttgaaacnctttgcataacgtataaaagcctgtttaagagacagccaactatggcctgtggatcaaatccagcctgctgcctgctttttatggcctgtgagctaggaattgtgtttataattttaaatgtttttttttaaagacttttatgatacttgaaaattaacatgaatatttagtgttcataaataaagtttgttgaaaccc

SEQ ID NO: 522 - DNA, 763 bp, Homo sapiens
  misc_feature (588)..(588): n is a, c, g, or t/u
  misc_feature (604)..(604): n is a, c, g, or t/u
  misc_feature (632)..(632): n is a, c, g, or t/u
  misc_feature (669)..(670): n is a, c, g, or t/u
  misc_feature (683)..(683): n is a, c, g, or t/u
  misc_feature (707)..(707): n is a, c, g, or t/u
  misc_feature (733)..(733): n is a, c, g, or t/u
ctggaaaaatctgtctgactctgaaaaggaattatatattcagcatgctaaagaggacgaaactcgttatcataatgaaatgaagtcttgggaagaacaaatgattgaagttggacgaaaggatcttctacgtcgcacaataaagaaacaacgaaaatatggtgctgaggagtgttaaaagtagaagattgagatgtgttcacaatggataggcacaggaaaccagttaggtctcaatacctgaagctatcgtaaaattaagaaaggataaagttggtaaaccttttatatttagtatctttttattcagctcatggacttctgccagcataatacttgctttggaaaacccagataaaggttcatgcaaactttattttgtgtttaggaactactgaggatcagagtaatccaagcaaatgtgaatcattttacctttgacaaaggtaaatcagactatgaagttttttttatacaggatgatgactatggaaagagtactcttgtttccttatattatggaggcaggagtttcgttttcaaaattgttcaaattgtagaaaccacggggtctgtgatataagtggnggttttcataaagcangcagaactcatctaggtaattacaggtnctaggataattcacattgtttcaaaggtgatgggtgnnatataatgattgntggtttagtgcactttgtttaaanggactgaaaaatataacctttcttangcttttctaaagaaaacaaaaaaattgtgc

SEQ ID NO: 523 - DNA, 714 bp, Homo sapiens
  misc_feature (566)..(566): n is a, c, g, or t/u
  misc_feature (633)..(633): n is a, c, g, or t/u
  misc_feature (660)..(660): n is a, c, g, or t/u
  misc_feature (674)..(674): n is a, c, g, or t/u
  misc_feature (684)..(684): n is a, c, g, or t/u
  misc_feature (690)..(690): n is a, c, g, or t/u
  misc_feature (702)..(702): n is a, c, g, or t/u
gggtttcaacaaactttatttatgaacactaaatattcatgttaattttcaagtatcataaaagtctttaaaaaaaaacatttaaaattataaacacaattcctagctcacaggccataaaaagcaggcagcaggctggatttgatccacaggccatagttggctgtctcttaaacaggcttttatacgttatgcaaagtgtttcaaattccagagactttggagacttttcgttttttagatttctcattttaaaacacacataatacaagttttctttctggatcaatatactcacgagagaaaataattcagaaaaaaataaaattccttacttaaaaaaagggaaaagctatagaacaaatgtttcgtcttaaaatatatttaggaaatgtaaaattaaagattaaaaattttattctatgcaacataaaataatatgcataaatctggcacataatttctttgtttttactttagaaaaaagacagtaagaaaaaagtttataaatttctcagtcccttttatacaaagttgcaactaaaaccagcaatcacttatatgtncaccatcaactctgaatacaatgtgaattatacctaaggaactgtaatttacctagatgagttctgnctgctttatgaaaaacacacacttatntcacaaaacaccgnggctttctcnatttgnaacaaattttgnaaaaccaaaact

SEQ ID NO: 524 - DNA, 784 bp, Homo sapiens
  misc_feature (681)..(681): n is a, c, g, or t/u
  misc_feature (689)..(689): n is a, c, g, or t/u
  misc_feature (696)..(696): n is a, c, g, or t/u
  misc_feature (703)..(703): n is a, c, g, or t/u
  misc_feature (723)..(723): n is a, c, g, or t/u
gcgggttccagttgtgattgctggagttgtgtattgccaggaggctctccgagattggggtcgggtcactgcctcatccaccggagcgatggcgtttctccgaagcatgtggggcgtgctgagtgccctgggaaggtctggagcagagctgtgcaccggctgtggaagtcgactgcgctcccccttcagttttgtgtatttaccgaggtggttttcatctgtcttggcaagttgtccaaagaaacctgtaagttcttaccttcgattttctaaagaacaactacccatatttaaagctcagaacccagatgcaaaaactacagaactaattagaagaattgcccagcgttggagggaacttcctgattcaaagaaaaaaatatatcaagatgcttatagggcggagtggcaggtatataaagaagagataagcagatttaaagaacagctaactccaagtcagattatgtctttggaaaaagaaatcatggacaaacatttaaaaaggaaagctatgacaaaaaaaaaagagttaacactgcttggaaaaccaaaaagacctcgttcagcttataaccgtttatgtagctgaaagattccaagaagctaagggtgattcacccgcaggaaaagctgaagactgtaaaggaaaactggaaaaatctgtctgactttgaaaangaattatntattcancatgctnaaagaggacgaaactcgttntcataatgaaatgaagtctttggaaagaacaaatgattgaaatttggaccaaaaggatctt

SEQ ID NO: 525 - DNA, 658 bp, Homo sapiens
  misc_feature (200)..(200): n is a, c, g, or t/u
  misc_feature (241)..(241): n is a, c, g, or t/u
  misc_feature (372)..(372): n is a, c, g, or t/u
  misc_feature (603)..(603): n is a, c, g, or t/u
  misc_feature (610)..(610): n is a, c, g, or t/u
gggtttcaacaaactttatttatgaacactaaatattcatgttaattttcaagtatcataaaagtctttaaaaaaaaacatttaaaattataaacacaattcctagctcacaggccataaaaagcaggcagcaggctggatttgatccacaggccatagttggctgtctcttaaacaggcttttatacgttatgcaaagngtttcaaattccagagactttggagacttttcgttttttanatttctcattttaaaacacacataatacaagttttctttctggatcaatatactcacgagagaaaataattcagaaaaaaataaaattccttacttaaaaaaagggaaaagctatagaacaaatgtttcgncttaaaatatatttaggaaatgtaaaattaaagattaaaaattttattctatgcaacataaaataatatgcataaatctggcacataatttctttgtttttactttagaaaaaagacagtaagaaaaaagtttataaatttctcagtcccttttatacaaagttgcaactaaaaccagcaatcacttatatgtcaaccatcaactctgaatacaatgtgaattatacctangaactgnaatttacctaaatgagttctgcctgctttatgaaaaacacacacttat

SEQ ID NO: 526 - DNA, 725 bp, Homo sapiens
  misc_feature (604)..(604): n is a, c, g, or t/u
  misc_feature (683)..(683): n is a, c, g, or t/u
ggagcgcgcacagtcggctcgcagcgcggcactacagcggccccggcccggcccccgcccggccccggcgcaggcagttcagattaaagaagctaattgatcaagaaatcaagtctcaggaggagaaggagcaagaaaaggagaaaagggtcaccaccctgaaagaggagctgaccaagctgaagtcttttgctttgatggtggtggatgaacagcaaaggctgacggcacagctcacccttcaaagacagaaaatccaagagctgaccacaaatgcaaaggaaacacataccaaactagcccttgctgaagccagagttcaggaggaagagcagaaggcaaccagactagagaaggaactgcaaacgcagaccacaaagtttcaccaagaccaagacacaattatggcgaagctcaccaatgaggacagtcaaaatcgccagcttcaacaaaagctggcagcactcagccggcagattgatgagttagaagagacaaacaggtctttacgaaaagcagaagaggagctgcaagatataaaagaaaaaatcagtaagggagaatatggaaacgctggtatcatggctgaagtggaagagctcangaaacgtgtgctagatatggaagggaaagatgaagagctcataaaaatggagggagcagtgcagagatctcaataagangctttgaaagggagacgtttcaaattaagacttttaactaga

SEQ ID NO: 527 - DNA, 764 bp, Homo sapiens
  misc_feature (50)..(50): n is a, c, g, or t/u
  misc_feature (105)..(105): n is a, c, g, or t/u
  misc_feature (116)..(116): n is a, c, g, or t/u
  misc_feature (120)..(120): n is a, c, g, or t/u
  misc_feature (128)..(128): n is a, c, g, or t/u
  misc_feature (143)..(143): n is a, c, g, or t/u
  misc_feature (156)..(156): n is a, c, g, or t/u
  misc_feature (159)..(159): n is a, c, g, or t/u
  misc_feature (169)..(169): n is a, c, g, or t/u
  misc_feature (172)..(172): n is a, c, g, or t/u
  misc_feature (181)..(181): n is a, c, g, or t/u
  misc_feature (187)..(187): n is a, c, g, or t/u
  misc_feature (220)..(220): n is a, c, g, or t/u
  misc_feature (231)..(231): n is a, c, g, or t/u
  misc_feature (273)..(273): n is a, c, g, or t/u
  misc_feature (321)..(321): n is a, c, g, or t/u
  misc_feature (426)..(426): n is a, c, g, or t/u
  misc_feature (441)..(441): n is a, c, g, or t/u
  misc_feature (489)..(489): n is a, c, g, or t/u
  misc_feature (561)..(561): n is a, c, g, or t/u
  misc_feature (574)..(574): n is a, c, g, or t/u
  misc_feature (602)..(602): n is a, c, g, or t/u
  misc_feature (615)..(615): n is a, c, g, or t/u
  misc_feature (646)..(646): n is a, c, g, or t/u
  misc_feature (652)..(652): n is a, c, g, or t/u
  misc_feature (678)..(678): n is a, c, g, or t/u
  misc_feature (681)..(681): n is a, c, g, or t/u
  misc_feature (687)..(687): n is a, c, g, or t/u
  misc_feature (689)..(689): n is a, c, g, or t/u
  misc_feature (699)..(699): n is a, c, g, or t/u
  misc_feature (711)..(711): n is a, c, g, or t/u
  misc_feature (713)..(713): n is a, c, g, or t/u
  misc_feature (724)..(724): n is a, c, g, or t/u
  misc_feature (746)..(746): n is a, c, g, or t/u
  misc_feature (751)..(751): n is a, c, g, or t/u
aaaaataacaaattatttactgttttataatgttaaagtatttcaccaanacaagttgcagtcaaattaaagtgagttatggaaaatgaaatacataaagatgtntttatacaagngcanactaaatnttttccatacaagtntgtaaatgaaaanatntacagtaagngcncactcgatntgactntgcaggcaacagttagtttcaaatactcttgtntagttcatgcncaaaccttcccaaagtacgagttcagtcagtcttgggggatntggagggatgattaaaaaaggattgagttccttgcaaaaatatcagtntggactggatgagggtgagccgtggtcagttatatatattacttactgtaatttgtgattgcaaggaaaaggtgtggctgttggtgtgatagtaatactgctggngactttattggttgntttgtttagggccccgttaattaagccttgagttcggttatcctgcantggtgctgaagggctggcaggtctcacagggctggcttcagctttgcatgtaaggacttcctaagggaatgnggattttattatnctcagtagttatcacacttgagctttgntggttgaaccctnaactgccatgatgactggccggtctgggganaccttnaatatccatgcttggcactggatttntgntgggtntnggggagcggncctgttcagganancttctgaccanccagccaaacctggaatggggnattgnccttttggagtaa

SEQ ID NO: 528 - DNA, 767 bp, Homo sapiens
  misc_feature (694)..(694): n is a, c, g, or t/u
agagcaggaaaatggactcattagggaggcaggcagtcattaccactcacactgtacttccagggagacaccgattataagaagagaaactcagcgctggggaagaaggcactgccaggacttaccgtacaacactccttggcttctggaattttatctctgctcacagtctacattacaacattagttcattctgggcactttagcttccttgaatctccagttgatctcacacccatgcctatgatattcttctcctggttaatcaagaattctctatttctgctccgtcatccatgccactacaaataaaaagaagtgttaagaattgcctttgggactctgaaggctgaagaattgatgaattgcaagtttgtgccccatagctgcacagactgcctgaagttacatttagagactgaaatcactgcaccttaaaaacaaaagattgagctgcactgtattcctaatgtttcatcattactaacaggatattcctcatgacattgctgtctgatctttgaccatcagtctgtgacctgccccttctctttacatgcagccgctctctgctccctgccccaatgaacatctgcactaggcccaagccttggagtaatttacctgaagagtgacaccattgatttttgaaactactggagaaacccaagacagctgaaaaccagaaggcttntgaggaggaatgagattactcaacccggtgggatccagcgcccaagcccgggctttccctgcctgaacctttg

SEQ ID NO: 529 - DNA, 681 bp, Homo sapiens
  misc_feature (550)..(550): n is a, c, g, or t/u
  misc_feature (556)..(556): n is a, c, g, or t/u
  misc_feature (575)..(575): n is a, c, g, or t/u
  misc_feature (596)..(596): n is a, c, g, or t/u
  misc_feature (601)..(601): n is a, c, g, or t/u
  misc_feature (613)..(613): n is a, c, g, or t/u
  misc_feature (626)..(626): n is a, c, g, or t/u
  misc_feature (649)..(649): n is a, c, g, or t/u
acttttttttaaaagatttttttgtaaagaagggttgtatttagaggccagtagctagagatccaaccagtggacctcttgaagcactaccaggccttaaggccaccatccgagggagactgggaaaactattattcacccaagcctccggaaatgtaatgtaccagcaggcaaaaaacagttcttcatgtagtacaaaatgaaacgaaacaaaaacaaaaacagaaagtaaaaatgaaaccaaaacatttcttaaattctagtgccatagcttttttgtttgtttgttttttgttgttgttttgttttgttcataagaaagagagaaagatactacttatccgtcagacacatgcatcctcatgtggtcgttgaactgctcgatttggtcaaactttgctgggcagacggagcagacgtaagtggtcccctccgtgcaggccaccacgcctggggggccagcgcgggcacctgggggtgtgcctgcagggggggtccattgctggcactgtgcagggccacgtgtcgctccaagagggtcttgtgaganaacttntttttgcagatgtagcacntcgaagactttttttccccgngggangcgcatgtcacnttgaagggagctntttttgggtgaaacacttgttgnaaatactacctgggatgccctcacttctgtgt

SEQ ID NO: 530 - DNA, 812 bp, Homo sapiens
  misc_feature (651)..(651): n is a, c, g, or t/u
  misc_feature (655)..(655): n is a, c, g, or t/u
  misc_feature (669)..(669): n is a, c, g, or t/u
  misc_feature (674)..(674): n is a, c, g, or t/u
  misc_feature (706)..(706): n is a, c, g, or t/u
  misc_feature (720)..(720): n is a, c, g, or t/u
  misc_feature (733)..(733): n is a, c, g, or t/u
gtctgaaggaggtaccagattatttggatcacattaaacatcccatggactttgccacaatgaggaaacggttagaagctcaagggtataaaaacctccatgagtttgaggaggattttgatctcattatagataactgcatgaagtacaatgccagggacaccgtgttctatagagccgcggtgaggctgcgcgatcagggaggtgttgttctgaggcaggcccggcgcgaggtggacagcatcggcttggaagaggcctcggggatgcacctgcctgagcggcctgctgcggcaccgcggcggcctttctcctgggaagacgtggacaggttgctggaccccgccaacagagcccacctgggcctggaggagcagctgagagagctgctggacatgctcgacctcacctgcgctatgaagtccagcggctcccggagcaagcgggcaaagctgctcaaaaaggaaattgcccttctccgaaacaagctgagccagcagcacagccagcccctgcccacggggccaggcttggaaggcttcgaagaggacggagctgcgctggggcccggaggcgggcgaagaagtccttccgaggttggagactcttctgcagccaaggaaaaggtcgcggagcacatgcggagacttncgangtggaggaggagtncccangaaaagcgcctggacgcaggtcttcaccaacngcttttggggtgcnaagagccaaccangaacccggccgggggccttgggggaggaaggccacaccccgacgaccttgggccttcgagttcaagattttctttcaag

SEQ ID NO: 531 - DNA, 781 bp, Homo sapiens
  misc_feature (550)..(550): n is a, c, g, or t/u
  misc_feature (623)..(623): n is a, c, g, or t/u
  misc_feature (690)..(690): n is a, c, g, or t/u
  misc_feature (702)..(702): n is a, c, g, or t/u
  misc_feature (712)..(712): n is a, c, g, or t/u
  misc_feature (729)..(729): n is a, c, g, or t/u
  misc_feature (732)..(732): n is a, c, g, or t/u
  misc_feature (735)..(735): n is a, c, g, or t/u
cttgactttatttttaatataaaaaatgcaaatttggaaacccaccctactttccccaacataatgctttacctcttaaaaataaaaataaagtactaattctatatacatcacaggtaccatacaaaaatgtatccaaagtttctattgctaccaaagtgttctaaattaaaacaagttacagaaagcccctcattgtaaacaaaagattacaagttataaaatcaaagtacacacaggccagagtcatttatacaatgcaatgcattctgctcccaagccaagttgaatttttatgtgcctgtataaaaatgcatatcaatatacctttgcaaatgtatttttcattataaagcaaatgaatacactttctacaataaataatccgctgggaggcacacctgcggggtttgaggtgggcgggacgacgggagcggggacacacccaccggcggtcacgggcagcggagtgtttttggtgatctgcaagtgatgtcacagcataactttattctcccctctttccacaaagtaccattcaaaataatgncattttctttcttaaaatacacatttgtcattgtaaatttacatcccgtcttattaaataagtggtactctgngtaaagagcatgatttacaaaattattaaacattcaaaagtctttaagaaaaagctacatatcaaanaaagtgacgccngcacaccggncttgggggacgtgcganaanacncactgggcttgcccggacgtgccccccccctttacagggccaaaac

SEQ ID NO: 532 - DNA, 708 bp, Homo sapiens
  misc_feature (595)..(595): n is a, c, g, or t/u
  misc_feature (611)..(611): n is a, c, g, or t/u
  misc_feature (613)..(613): n is a, c, g, or t/u
  misc_feature (663)..(663): n is a, c, g, or t/u
  misc_feature (671)..(671): n is a, c, g, or t/u
cggagacccggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttcttatctggtgacagtgccttctgggcccagtttggctgatgctctcatcagttcttcnattttggctggtgaangnggtgcccttgctgggtcttgggtgccagtgacttttgaattttggagtanaatcccantgcttgatccttgagcttgggccttggccccttctgt

SEQ ID NO: 533 - DNA, 692 bp, Homo sapiens
  misc_feature (547)..(547): n is a, c, g, or t/u
  misc_feature (592)..(592): n is a, c, g, or t/u
  misc_feature (600)..(600): n is a, c, g, or t/u
gatttctgcccagggatttgctcaccccaaggtcatctgataatttcacagatgctgtgtaacagaacacagccaaagtaaactgtgtaggggagccacatttacataggaaccaaatcaatgaatttaggggttacgattatagcaatttaagggcccaccagaagcaggcctcgaggagtcaatttgcctctgtgtgcctcagtggagacaagtgggaaaacatggtcccacctgtgcgagaccccctgtcctgtgctgctcactcaacaacatctttgtgttgctttcaccaggctgagaccctaccctatggggtatatgggcttttacctgtgcaccagtgtgacaggaaagattcatgtcactactgtccgtggctacaattcaaaggtatccaatgtcgctgtaaattttatggcactatttttattggaggatttggtcagaatgcagttgttgtacaactcataaatactaactgctgattttgacacatgtgtgcttcaaatgatctggtggttatttaacgtacctcttaaaattngttgaaacgatttcaggtcaactctgaagagtattttgaaagcangactttanaacagtgtttgatttttattttataaatttaagcatttcaaattaggcaaatctttggctgcaggcagcaaaaaacaggcttggacttattt

SEQ ID NO: 534 - DNA, 546 bp, Homo sapiens
  misc_feature (146)..(146): n is a, c, g, or t/u
  misc_feature (278)..(279): n is a, c, g, or t/u
  misc_feature (293)..(294): n is a, c, g, or t/u
  misc_feature (301)..(301): n is a, c, g, or t/u
  misc_feature (329)..(329): n is a, c, g, or t/u
  misc_feature (332)..(332): n is a, c, g, or t/u
  misc_feature (350)..(351): n is a, c, g, or t/u
  misc_feature (362)..(362): n is a, c, g, or t/u
  misc_feature (372)..(372): n is a, c, g, or t/u
  misc_feature (378)..(378): n is a, c, g, or t/u
  misc_feature (386)..(386): n is a, c, g, or t/u
  misc_feature (398)..(398): n is a, c, g, or t/u
  misc_feature (400)..(400): n is a, c, g, or t/u
  misc_feature (402)..(405): n is a, c, g, or t/u
  misc_feature (411)..(411): n is a, c, g, or t/u
  misc_feature (416)..(416): n is a, c, g, or t/u
  misc_feature (422)..(422): n is a, c, g, or t/u
  misc_feature (427)..(429): n is a, c, g, or t/u
  misc_feature (433)..(433): n is a, c, g, or t/u
  misc_feature (437)..(437): n is a, c, g, or t/u
  misc_feature (447)..(447): n is a, c, g, or t/u
  misc_feature (450)..(450): n is a, c, g, or t/u
  misc_feature (456)..(457): n is a, c, g, or t/u
  misc_feature (465)..(467): n is a, c, g, or t/u
  misc_feature (469)..(469): n is a, c, g, or t/u
  misc_feature (472)..(472): n is a, c, g, or t/u
  misc_feature (475)..(476): n is a, c, g, or t/u
  misc_feature (488)..(488): n is a, c, g, or t/u
  misc_feature (490)..(490): n is a, c, g, or t/u
  misc_feature (506)..(506): n is a, c, g, or t/u
  misc_feature (508)..(508): n is a, c, g, or t/u
  misc_feature (517)..(517): n is a, c, g, or t/u
  misc_feature (523)..(523): n is a, c, g, or t/u
  misc_feature (526)..(526): n is a, c, g, or t/u
  misc_feature (528)..(529): n is a, c, g, or t/u
  misc_feature (531)..(531): n is a, c, g, or t/u
  misc_feature (534)..(534): n is a, c, g, or t/u
  misc_feature (536)..(536): n is a, c, g, or t/u
  misc_feature (538)..(539): n is a, c, g, or t/u
  misc_feature (541)..(541): n is a, c, g, or t/u
gttgttgttgttgttcagatggagtctctctctgttcttgttgttgttgagatggagtctctctctgcccaggatggagcgcagtagtgcaatctcagctcactgcaacctccgcctcccgggttcaagcaattcttctgcctcancctccaagtagctgtggcaggagaatggcgtgaacctgggaggcagagtttgcagtgagccgagattgcgccactgcactccagcctgagtgacagagcgagattccgtgaacaagtaattcttcacactgnnattttatgtctgtnngcttaangaagaaatcatgaatttttcttctaaanaangtattctgttgacaccannctattggaaanattttcaacntaaggngatgctangactggcctccnancnnnnaattgngaagnaaagancatgnnntggncggntcctccaaanaanaaattnnctacccgnnngnccntanngaaatttccacncnccgccttcttcttttncntacacaccnaaatcncgntnncnaanangnnanacgga

SEQ ID NO: 535 - DNA, 784 bp, Homo sapiens
  misc_feature (609)..(609): n is a, c, g, or t/u
  misc_feature (627)..(627): n is a, c, g, or t/u
  misc_feature (641)..(641): n is a, c, g, or t/u
  misc_feature (644)..(644): n is a, c, g, or t/u
  misc_feature (670)..(670): n is a, c, g, or t/u
  misc_feature (673)..(673): n is a, c, g, or t/u
  misc_feature (685)..(685): n is a, c, g, or t/u
  misc_feature (712)..(712): n is a, c, g, or t/u
  misc_feature (721)..(721): n is a, c, g, or t/u
  misc_feature (727)..(727): n is a, c, g, or t/u
  misc_feature (733)..(733): n is a, c, g, or t/u
  misc_feature (736)..(736): n is a, c, g, or t/u
  misc_feature (739)..(739): n is a, c, g, or t/u
  misc_feature (768)..(768): n is a, c, g, or t/u
gccccaaggaagaggacatggaggtggacatacctgctgtgaaagtgaaagaggagccacgagatgaggaggaagaggccaagatgaaggctcctcccaaagcagccaggaagactccaggcctcccgaaggatgtatctgtggcagagctgctgagggagctgagcctcaccaaggaagaggaactgctgtttctgcagctgccagacaccctccctggccagccacccacccaggacatcaagcctatcaagacagaggtgcagggcgaggacggacaggtggtgctcatcaagcaggagaaagaccgagaagccaaattggcagagaatgcttgtaccctggctgacctgacagagggtcaggttggcaagctactcatccgcaagtctggaagggtgcaactcctcttgggcaaggtgactctggacgtgaccatgggaactgcctgctccttcctgcaggagctggtgtccgtgggccttggagacagtaggacaggggagatgacagtcctgggacacgtgaagcacaaacttgtatgttcccctgattttgaatccctcttggatcacaaacaccggtaaaatgaacaagtggaggaagacngcgcctgtgccccaccgnttgctgccttgctncanacatttttgttcttggaatctgtganaanccaaaaaggggnccccttgagccccacttcactttcagncttttgggnaaccantggttncangtncccccaagggctttccttccccaacaacntgtggaattgggacaa

SEQ ID NO: 536 - DNA, 735 bp, Homo sapiens
  misc_feature (145)..(145): n is a, c, g, or t/u
  misc_feature (576)..(576): n is a, c, g, or t/u
  misc_feature (598)..(598): n is a, c, g, or t/u
  misc_feature (611)..(611): n is a, c, g, or t/u
  misc_feature (635)..(636): n is a, c, g, or t/u
  misc_feature (650)..(650): n is a, c, g, or t/u
  misc_feature (664)..(664): n is a, c, g, or t/u
  misc_feature (680)..(680): n is a, c, g, or t/u
  misc_feature (688)..(688): n is a, c, g, or t/u
  misc_feature (704)..(704): n is a, c, g, or t/u
  misc_feature (711)..(711): n is a, c, g, or t/u
agagaaaaaggacatgaacgtttattgagtgcctgctggttctggccttgtgcagttttcatctataagagcccatgaatcctcacgccaaccctggaggtaggtatcatccccatttgtgtcggatgaggtataggaggctcanaaaggttaggtagtttgtccaaggacacagaaccaggaactggcaagctgggaccgagtgcttaagtctcagactcaatccttgctctctctcctatactgcctccaggaggacggggggagcaccagcagaagctgcagtccacacgcttcctgcccctgcaacccagcaggcaccaagagaagccagccccttcacacagaccctccccatctacccttggaggatgcatcaagtggaagagattaagacataaatacaaaaataaatagcagggccaagtccccagcagcaaggatgtgccatctccacgctgcaggaaggtcactgtgccattcacagctgctgtgggaggaaaccctgggggacctggaacaatggttgccaaaggctggaatgagtgggctcaaatggggccccttctggggctncaaaattcaagaacaaaatgtnttggacaaggcancaacccgggggcccaaggcgcccnncttccttcacctgnttatttttaccggnggtttgggatcccaanagggattnaaaaatcaaggggaanatacaantttgtggcttacgttttcccaaga

SEQ ID NO: 537 - DNA, 601 bp, Homo sapiens
  misc_feature (208)..(208): n is a, c, g, or t/u
  misc_feature (244)..(244): n is a, c, g, or t/u
  misc_feature (418)..(418): n is a, c, g, or t/u
  misc_feature (432)..(432): n is a, c, g, or t/u
  misc_feature (450)..(451): n is a, c, g, or t/u
  misc_feature (456)..(456): n is a, c, g, or t/u
  misc_feature (459)..(459): n is a, c, g, or t/u
  misc_feature (462)..(462): n is a, c, g, or t/u
  misc_feature (467)..(467): n is a, c, g, or t/u
  misc_feature (478)..(478): n is a, c, g, or t/u
  misc_feature (505)..(505): n is a, c, g, or t/u
  misc_feature (509)..(509): n is a, c, g, or t/u
  misc_feature (544)..(544): n is a, c, g, or t/u
  misc_feature (546)..(546): n is a, c, g, or t/u
aagcaattaaacgttcaaatgaatatgagtaatgtaatgggaaatacaacttggacaactagtggtttgaagagccagggccgtctgtcagtaggaagtaatcgtgatccgagagatcaagcatgtctgttggtctgggaagatcacaattagattctaaaggaggagtagttggagggaccatagatgtcaatgctttggagatggntgctcatatttctgaacatccaaatcagcaacccantcacaaaattcagattactatgggttctactgaagctcgtgttgattacatgggctcaagtatcctcatgggcatcttcagtaatgctgatcttaagcttcaggatgaatggaaagtaaacttgtataatacattggattcaagcataactgataaaagtgagattttcgtccnttggagatttgaangtgggatatttttccaanntaatnatnttnaaggncaaccacaccngatctggtaaaaaataggaatgaagcnccangaattttttcacacaacaatttgatccagcaaacnanctctgtcttcctgggggaccagttccttaaccttcccccaaagaacaatgacttt

SEQ ID NO: 538 - DNA, 673 bp, Homo sapiens
  misc_feature (508)..(508): n is a, c, g, or t/u
  misc_feature (520)..(520): n is a, c, g, or t/u
  misc_feature (549)..(549): n is a, c, g, or t/u
  misc_feature (573)..(573): n is a, c, g, or t/u
  misc_feature (593)..(593): n is a, c, g, or t/u
  misc_feature (629)..(629): n is a, c, g, or t/u
  misc_feature (636)..(636): n is a, c, g, or t/u
aaaccattactgtgactttattataatagttaacaatattttagtggtatacaatcatatcacaattactcaagctatatacaaacaggtatttatataagtctacatttaaaaaagaaaaagcaattaatgacctccccaaaatcacattatcatcaacaagatttttttctaaaagttacggccaatccaataacaaaaaaattcacagttattctgcagacattttaaagatgcaggaattgtattgcacattatataattataaaccataacaagcagttatatattttaatctagtttttcacaaaatttacattatcatgcaatacttcactgtacacagaatgatggaactagaacaggttaacttacaaacttttaattatagccacaaatttagaattattttaaagttatatttcaaattattatactaaaaaaacactccagtgtaataaaacagacacaatcataatttgttcacagatcaaattacttttttagngttcttctttgnctttgcctttcttttccttttcatcctgnagtgcagtaccgagctttttgatnagaactgacagaaccttgtncagtggatccatgactcctctttggaagccatttangaatagnaggcctagcatggatgaaagcccaattttggaggaat

SEQ ID NO: 539 - DNA, 691 bp, Homo sapiens
  misc_feature (547)..(547): n is a, c, g, or t/u
  misc_feature (574)..(574): n is a, c, g, or t/u
  misc_feature (608)..(608): n is a, c, g, or t/u
  misc_feature (666)..(666): n is a, c, g, or t/u
  misc_feature (674)..(674): n is a, c, g, or t/u
ggaggccggaactacaccagcaaaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagggaggtgaagcagcaggaggaagaaccccaggtggacgtatgggagttgctgaagaacgcgaaacccagtgagtacgaaaagatcgccttncagtatggaatcaccgatctgcgccgnatgctcaaacgactcaagcgcatgccgcagagangagaaaaaagaccgcacttttgccaaaaaattcttggatcctgcctatcaggttgacnaaaaggangcacaatgagggttgtt

SEQ ID NO: 540 - DNA, 667 bp, Homo sapiens
  misc_feature (168)..(168): n is a, c, g, or t/u
  misc_feature (196)..(196): n is a, c, g, or t/u
  misc_feature (217)..(217): n is a, c, g, or t/u
  misc_feature (566)..(566): n is a, c, g, or t/u
  misc_feature (587)..(587): n is a, c, g, or t/u
  misc_feature (592)..(592): n is a, c, g, or t/u
  misc_feature (607)..(607): n is a, c, g, or t/u
  misc_feature (663)..(663): n is a, c, g, or t/u
ctcttcaacattaggaggaaagaaaaagaccacacttgggggcctggtgggaaaacagaaaatgctttttctcatttcaaccagatttcaaagcagcagagtgcagagagacagtagccaggccctccctcagtattcctcaggattgcttgagtgtaagtctcgcanatatgaatcaattatgtttggaggtacnccttgcaagaggagtctgcanaaggagagcccacctttcacctccagtttgcattcaatctccactgtcccaaggtcattgactgctttgcagcagtaagtgcctccatcataggggctgggcttgcgaatttccagggtacagactccctggttgctgaacatcctgtatcttggatcatccacaatagcaactttgtttttcatccaggttattttaggcttaggatttcctctcacactgcagtttagggtggcattgtaaccagctatggcataggtgttaaccaaaggctgagtaaacatgggtgcctctgagaaatcaaaagtcttcatcactgggattttgtagatttaccatccctggcgancactggacttttttaatcatnggggnattcctcctgagggncccacatgtttttcaaaaaaaaacccggaaggaatttttttccctttgaccaattnaatt

SEQ ID NO: 541 - DNA, 763 bp, Homo sapiens
  misc_feature (660)..(660): n is a, c, g, or t/u
  misc_feature (669)..(669): n is a, c, g, or t/u
  misc_feature (679)..(679): n is a, c, g, or t/u
  misc_feature (682)..(682): n is a, c, g, or t/u
  misc_feature (712)..(712): n is a, c, g, or t/u
  misc_feature (721)..(721): n is a, c, g, or t/u
  misc_feature (739)..(739): n is a, c, g, or t/u
cctgcctcagcctcccaagtagctgggaccacaggcagttatacttaagcatgaacattgacgacaaactggaaggattgtttcttaaatgtggcggcatagacgaaatgcagtcttccaggacaatggttgtaatgggtggagtgtctggccagtctactgtgtctggagagctacaggattcagtacttcaagatcgaagtatgcctcaccaggagatccttgctgcagatgaagtgttacaagaaagtgaaatgagacaacaggatatgatatcacatgatgaactcatggtccatgaggagacagtgaaaaatgatgaagagcagatggaaacacatgaaagacttcctcaaggactacagtatgcacttaatgtccctataagcgtaaagcaggaaattacttttactgatgtatctgagcaactgatgagagacaaaaaacaaatcagagagccagtagacttacagaaaaagaagaagcggaaacaacgttctcccgcaaaaatccttacaataaatgaggatggatcacttggtttgaaaacccctaaatctcacgtttgtgagcactgcaatgctgcctttagaacgaactatccttacagagacatgtcttcttcatacaggtgaaaaaccatttcaatgtagtccatgngacatgcgnttcataccanaantacctgctttagagacattgaaaagattcntactggtgnaaaacccttttcccttgngaatgaatgtgggtttgagaattc

SEQ ID NO: 542 - DNA, 778 bp, Homo sapiens
  misc_feature (612)..(612): n is a, c, g, or t/u
  misc_feature (630)..(630): n is a, c, g, or t/u
  misc_feature (659)..(659): n is a, c, g, or t/u
  misc_feature (682)..(682): n is a, c, g, or t/u
  misc_feature (694)..(694): n is a, c, g, or t/u
  misc_feature (706)..(706): n is a, c, g, or t/u
  misc_feature (709)..(709): n is a, c, g, or t/u
  misc_feature (720)..(720): n is a, c, g, or t/u
  misc_feature (725)..(725): n is a, c, g, or t/u
  misc_feature (760)..(760): n is a, c, g, or t/u
agtttttctgattcagatgatgatagctgtctttggaaacgcaaacgacagaaatgttttaaccctcctcccaaaccagagccttttcagtttggccagagcagtcagaaaccacctgttgctggaggaaagaagattaacaacatatggggtgctgtgctgcaggaacagaatcaagatgcagtggccactgaacttggtatcttgggaatggagggcactattgacagaagcagacaatccgagacctacaattatttgcttgccaagaaacttaggaaggaatctcaagagcatacaaaagatctagacaaggaactagatgaatatatgcatggtggcaaaaaaatgggatcaaaggaagaggaaaatgggcaaggtcatctcaaaaggaaacgacctgtcaaagacaggctagggaacagaccagaaatgaactataaaggtcgataccagatcacagcggaagattctcaagagaaagtggctgatgaaatttcattcaggttacaggaaccaaagaaagacctgatagccccgagtagtgaggattattggtacaaaaaggcaattgaacttctgatggaaacccgctgaagttgacaaaatggnggcttttatatgaatggnagtcgaagaaaaacccaagtggagttttntgatctttgaaacactctagttnagcgaggacaantaaggcattttntcnttgaaaccaanggatntaaaataaaaactgttgaaaagggacacagtgttngggaaaaataaaaacttt

SEQ ID NO: 543 - DNA, 725 bp, Homo sapiens
  misc_feature (150)..(150): n is a, c, g, or t/u
  misc_feature (167)..(167): n is a, c, g, or t/u
  misc_feature (573)..(573): n is a, c, g, or t/u
  misc_feature (645)..(645): n is a, c, g, or t/u
gagacagagtcttgctctgtcgcccaggctggagtacagtggtacgatctcagctcactgcaacctttgcctcccgggttcaggtgattctcctgcctcagcctcccgagtagccgggattataggcatggagaaccacacctggctagnttttgtatttttagtanagatgaagtttcaccatgttggcctggctggtctcaaactcctgacctcaagtgatctgcccgccttggtctcccaaagtgttgggattacaggcgtgagccaccgtgcctggccaatgttagtttttatccttaaaattgcctgagttcttagaacacagaaaaaacaaatttgaatgcatttctaacagcttaataatttatatgtcccattatgattttagcggaatgttttaaagcaaagcataattcactgcaaagataaacctgaaaaagcaaacaaacttacaaatggtatgttatgacctagacaaaactgattatcaactagtaatactcataattagcacatgcaacaagattgagaaattaaatcctgtgctatatactcttaaagtatttttgncaaaatatatctttaaaatgttctatcaattgcatttctttccacacatatttttaaaccaagaaaaacaanttggtcttttcctccaagaattctcatggtttattcaagtggcaaaaacgttggcaatctcaagttaaaaaatggggtta

SEQ ID NO: 544 - DNA, 904 bp, Homo sapiens
tggagctcgcgcgcctgcaggtcgacactagtggatccaaagctgccttcgagcctgccattgatatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaaagtctgttccaaataaagccttggaattggaagaatgaacaaacattgagagccgatgaaatactcccatcagaatccaaccaaaggactattgaagaaagttcttgggatttttga

SEQ ID NO: 545 - DNA, 1088 bp, Homo sapiens
  misc_feature (313)..(313): n is a, c, g, or t/u
  misc_feature (448)..(448): n is a, c, g, or t/u
  misc_feature (469)..(469): n is a, c, g, or t/u
atccactagatccagcattaaccaaggccaaatagacttaacttttcttccagaagttgcaagtattatatttttgaaactacttctgtttctgctttctcttttcatattgatatatacggttttttaaatggttattgtaattaaatatctcctcatttttctcttttaggagatgatgttgcattttcctctcaagaaaatgaatatcaattgttatcttgcttttgttgtcagctttcttatgtgcatgaactaattgctgttgaagccacatatttttgctttgtagttgaaataatttctgatctanagactcctgctgttcagtgtgtttgttcacattatcttgttcgttttgatacatgtgttcagcttccttcatttgacactgtgtttcacgttggtctctttgtgcatgttctgaaaccaatgtattttctcttanagcatctccggcataattganattaatttttaggcttttggatttcctttgagcttcaaaaagtggttgatggagcacctcattgttatatatcgtactactcacatcaacattcatttttctttgcaaacaagcatctcctgcaatgtggaaagcaggttcttgactttttcttgatgtcacaatttgatcatggtcttgtacagcagaagccagtctaggatggtgtgattcaatttctgcctctagtatttctttgtcttgtttttccttcaatttagaagtgagcattgtgttctcagctatcagaactttaagctgcccactatattgagatgcccttttagttaatgattcctctttcagttttagggtcatctgaagttcagcattcttttcttttaaaatcttaatgtcctcaaagtatttattttccttttcctggtattggtgtttcagtgtggctatttccagttttagcatggcaatttcctttttcaacatgcaattttcatgtaagagataattttcattttcatgagtgtgagaaacctgattcaaattactttctacactcttcaattctatatcttgtattctgagagcctgttcaagttgttgtttcacttctaactctttc

SEQ ID NO: 546 - DNA, 814 bp, Homo sapiens
  misc_feature (553)..(553): n is a, c, g, or t/u
  misc_feature (618)..(618): n is a, c, g, or t/u
  misc_feature (635)..(635): n is a, c, g, or t/u
  misc_feature (666)..(666): n is a, c, g, or t/u
  misc_feature (689)..(689): n is a, c, g, or t/u
  misc_feature (718)..(718): n is a, c, g, or t/u
  misc_feature (730)..(730): n is a, c, g, or t/u
  misc_feature (772)..(772): n is a, c, g, or t/u
  misc_feature (801)..(801): n is a, c, g, or t/u
tgtaggcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagcccatctgcttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttccanaaggatgtgtgtttcccaaggctgcgcatcaaaaagaaatagattaaataatgggaaattagaanggcttctgttaagatgncttctgaagcttactgcggatgaaagttctnttccacttaagccttaaaatgtngaatgcaactttcaagcagagcctccganaagcattgcttnacctgcattgaaagcaaaagctgtccataaacctggattganaagacaacctggagcaatgaatctcctcnaaccaccaagctt

SEQ ID NO: 547 - DNA, 589 bp, Homo sapiens
  misc_feature (189)..(189): n is a, c, g, or t/u
  misc_feature (345)..(345): n is a, c, g, or t/u
  misc_feature (364)..(364): n is a, c, g, or t/u
  misc_feature (368)..(368): n is a, c, g, or t/u
  misc_feature (400)..(400): n is a, c, g, or t/u
  misc_feature (503)..(503): n is a, c, g, or t/u
gagacagagtctcactctgtcgctcaggctggagtgcagtagtgggatctcggctcacctgcctctagggttcaagccattctcctgcctcagcctcccaagtagctgggattacagaggcgtgcaccaccatgaccacctaattttttcttgtttgttttgtttttttgggttttgtttttttttganatggagtctctctctgtcacccaggctggagtgcagtagtgggatctcagctcacctgcctccagggttcaagccattctcctgcctcagcctcccaagtagctgggattacagaggcgtgcaccaccatgcccacctaattttttcttgttttgnttttctggttctttttganacanagtcttgctctgtcgcccaagctggagtgcantggcgcgatctaagctcactgcaagctccacctcccagattcacgccattctgctatgagtaaaatcacctggttggattgaatgatgctgctgcatcatcanggtagaatgggaatcctgtgcaagctttatgcaattcgtgaacaaagtaattcttcacactggtattttatgtctgtaaggcttca

SEQ ID NO: 548 - DNA, 776 bp, Homo sapiens
  misc_feature (667)..(667): n is a, c, g, or t/u
  misc_feature (683)..(683): n is a, c, g, or t/u
  misc_feature (724)..(724): n is a, c, g, or t/u
  misc_feature (735)..(735): n is a, c, g, or t/u
  misc_feature (745)..(745): n is a, c, g, or t/u
  misc_feature (750)..(750): n is a, c, g, or t/u
agatactcccatcagaatccaaacaaaaggactatgaagaaagttcttgggattctgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaaagtctgttncaaataaagccttggnattggaagaatgaacaaacattgagagccgatgaaatactnccatcagaatnccaaccaaanggctnttgaagaaagttcttgggatttttga

SEQ ID NO: 549 - DNA, 820 bp, Homo sapiens
  misc_feature (620)..(620): n is a, c, g, or t/u
  misc_feature (665)..(665): n is a, c, g, or t/u
  misc_feature (670)..(670): n is a, c, g, or t/u
  misc_feature (685)..(685): n is a, c, g, or t/u
  misc_feature (714)..(714): n is a, c, g, or t/u
  misc_feature (727)..(727): n is a, c, g, or t/u
  misc_feature (744)..(744): n is a, c, g, or t/u
  misc_feature (758)..(758): n is a, c, g, or t/u
  misc_feature (764)..(764): n is a, c, g, or t/u
  misc_feature (769)..(769): n is a, c, g, or t/u
  misc_feature (787)..(787): n is a, c, g, or t/u
  misc_feature (801)..(801): n is a, c, g, or t/u
gaatgaacaaacattgagagcagatgagatactcccatcagaatccaaacaaaaggactatgaagaaagttcttgggattctgagagtctctgtgagactgtttcacagaaggatgtgtgtttacccaaggctacacatcaaaaagaaatagataaaataaatggaaaattagaagagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtcccaaggctacacatcaaaaagaaatggataaaataagtggaaaattagagagactcttagcttcatcctgtaccaagagagtctgataggtcccctcattttttctttctgtgtcacgttttggaatcttgtcaagcangaagctgaacattcttaaaatcactacctatcaaaatcttgatcngtcantcttgggaagaccangggacttcaaaagatactgggacccctcncggaaatgggccnatgaaaaaaagttttgntcttgaaaaaactntcgaancaaanaattaatccccgtttggnaccaaaagttaatngggccaaacccttccgggg

SEQ ID NO: 550 - DNA, 713 bp, Homo sapiens
  misc_feature (417)..(417): n is a, c, g, or t/u
  misc_feature (486)..(486): n is a, c, g, or t/u
  misc_feature (558)..(558): n is a, c, g, or t/u
  misc_feature (574)..(574): n is a, c, g, or t/u
  misc_feature (579)..(579): n is a, c, g, or t/u
  misc_feature (621)..(621): n is a, c, g, or t/u
  misc_feature (637)..(637): n is a, c, g, or t/u
  misc_feature (685)..(685): n is a, c, g, or t/u
aaatagaaggtgagaaaattatacatgggagaaaaaatgtatccacaatttttaggaaattagcaaggctctcgcataaacaatagtttttaaacgatgtcccatagaaatctaaggtactacagaggacatagcagtattaagggataatgaagtcacagcttcagagcctccatcctttctttagcaagttagctctacttgtatctgttctgttttatataatatggttgcatctaactgtttttaaaaaaagttctgttcttcaaaaaaattttaagctatgaaaatcactgattaagtcaaaccctcattttacaaaagaggcaacacaaactcagagcacttatgcctcaccataggtcacaaagccaagtagctccaggccagaaatgggctttaggtcttccgtctganactggcatttgatgccagtgatttcctccatatttaggagaaatgtatagattttaaaatataactcanagaaaatgcatgcatatggtaaaactgtcttctagctcaatcatgtttaggggcaacagggtaaaaaatagntctccagctaaattgngaatnctaaaattagaaatacaaagtaggccatagaaactaatatcntaacatcaggggaganggaggcaattaatctatttgtaaagaacaagtttggttaaaactccanaaaaaaggacctcggaagggagaaaaat

SEQ ID NO: 551 - DNA, 708 bp, Homo sapiens
  misc_feature (605)..(605): n is a, c, g, or t/u
  misc_feature (676)..(676): n is a, c, g, or t/u
caaaaggactatgaagaaagttcttgggattctgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctgcgcatcaaaaagaaatagataaaataaatggaaaattagaagggtctcctgttaaagatggcttctgaaggctaactgcggaatgaaagttctattcaactaaagccttagaattgatggacatgccaactttcaagcagacctccgagaagcctctgcttcnacctgcattgaatgccaaaatctgttccaataaagccttggaattgaagaatgaaccaacatttgagagcngatgagatctccctcagaatccaccaaaggct

SEQ ID NO: 552 - DNA, 716 bp, Homo sapiens
  misc_feature (208)..(208): n is a, c, g, or t/u
  misc_feature (210)..(210): n is a, c, g, or t/u
  misc_feature (343)..(343): n is a, c, g, or t/u
  misc_feature (402)..(402): n is a, c, g, or t/u
  misc_feature (570)..(570): n is a, c, g, or t/u
  misc_feature (639)..(639): n is a, c, g, or t/u
  misc_feature (651)..(651): n is a, c, g, or t/u
  misc_feature (655)..(655): n is a, c, g, or t/u
  misc_feature (668)..(668): n is a, c, g, or t/u
catattgatatatacggttttttaaatggttattgtaattaaatatctcctcatttttctcttttaggagatgatgttgcattttcctctcaagaaaatgaatatcaattgttatcttgcttttgttgtcagctttcttatgtgcatgaactaattgctgttgaagccacatatttttgctttgtagttgaaataatttctgatctananactcctgctgttcagtgtgtttgttcacattatcttgttcgttttgatacatgtgttcagcttccttcatttgacactgtgtttcacgttggtctctttgtgcatgttctgaaaccaatgtattttctcttanagcatctccggcataattgagattaatttttaggcttttggatttcctttgagcttcanaaagtggttgatggagcacctcattgttatatatcgtactactcacatcaacattcatttttctttgcaaacaagcatctcctgcaatgtggaaagcaggttcttgactttttcttgatgtcacaatttgatcatgggcttgtccagcagaagccagtctaggatggnggtgattcaatttctgcctctaatatttctttggcttggttttccttcaatttaaaaagtgagcattgnggttctcaactntcanaactttaagctgnccacttttttgagaagccccttttagtaaagaatcctctttcagttta

SEQ ID NO: 553 - DNA, 713 bp, Homo sapiens
  misc_feature (465)..(465): n is a, c, g, or t/u
  misc_feature (634)..(634): n is a, c, g, or t/u
  misc_feature (641)..(641): n is a, c, g, or t/u
  misc_feature (650)..(650): n is a, c, g, or t/u
  misc_feature (656)..(656): n is a, c, g, or t/u
aatgaacaaacattgagagcagatgagatactcccatcagaatccaaacaaaaggactatgaagaaagttcttgggattctgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacanaaggatgtgtgtttcccaaggctgcgcatcaaaaagaaatagataaaataaatggaaaattaaagggctcctgttaagatggcttctgaaggctaactgcggaatgaagtttctatttcaactaagccttagaattgtggacatgccaactttcaagcaaacctccganaagcctntgcttctancctgcnttgaaagcaaagctgttccaataagcctggaatgagaatgaccaaccttggagcaat

SEQ ID NO: 554 - DNA, 750 bp, Homo sapiens
  misc_feature (70)..(70): n is a, c, g, or t/u
  misc_feature (208)..(208): n is a, c, g, or t/u
  misc_feature (264)..(264): n is a, c, g, or t/u
  misc_feature (290)..(290): n is a, c, g, or t/u
  misc_feature (343)..(343): n is a, c, g, or t/u
  misc_feature (400)..(400): n is a, c, g, or t/u
  misc_feature (402)..(402): n is a, c, g, or t/u
  misc_feature (489)..(489): n is a, c, g, or t/u
  misc_feature (539)..(539): n is a, c, g, or t/u
  misc_feature (569)..(569): n is a, c, g, or t/u
  misc_feature (571)..(571): n is a, c, g, or t/u
  misc_feature (587)..(587): n is a, c, g, or t/u
  misc_feature (592)..(592): n is a, c, g, or t/u
  misc_feature (639)..(639): n is a, c, g, or t/u
  misc_feature (641)..(641): n is a, c, g, or t/u
  misc_feature (655)..(655): n is a, c, g, or t/u
  misc_feature (672)..(672): n is a, c, g, or t/u
  misc_feature (676)..(676): n is a, c, g, or t/u
catattgatatatacggttttttaaatggttattgtaattaaatatctcctcatttttctcttttagganatgatgttgcattttcctctcaagaaaatgaatatcaattgttatcttgcttttgttgtcagctttcttatgtgcatgaactaattgctgttgaagccacatatttttgctttgtagttgaaataatttctgatctanagactcctgctgttcagtgtgtttgttcacattatcttgttcgttttgatacatgngttcagcttccttcatttgacactgngtttcacgttggtctctttgtgcatgttctgaaaccaatgtattttctcttanagcatctccggcataattgagattaatttttaggcttttggatttcctttgagcttnanaaagtggttgatggagcacctcattgttatatatcgtactactcacatcaacattcatttttctttgcaaacaagcatctcctgcantgtggaaagcaggttcttgactttttcttgatgtccaatttgatcatggncttgtacagcaaaaaccagtctaggatggngngaatcaatttctggcnctagnatttctttggcttggtttcccttcaattttaaaaagtgaaccattgngnttctcaactttcanaacttttaagctgcccncctnttttggagaagccccttttaagttaaatgaatccctctttcaagtttttaaggggcatctggaaattcaaacat

SEQ ID NO: 555 - DNA, 700 bp, Homo sapiens
  misc_feature (586)..(586): n is a, c, g, or t/u
  misc_feature (608)..(608): n is a, c, g, or t/u
  misc_feature (614)..(614): n is a, c, g, or t/u
  misc_feature (632)..(632): n is a, c, g, or t/u
  misc_feature (665)..(665): n is a, c, g, or t/u
aagaaatactagaggcagaaattgaatcacaccatcctagactggcttctgctgtacaagaccatgatcaaattgtgacatcaagaaaaagtcaagaacctgctttccacattgcaggagatgcttgtttgcaaagaaaaatgaatgttgatgtgagtagtacgatatataacaatgaggtgctccatcaaccactttctgaagctcaaaggaaatccaaaagcctaaaaattaatctcaattatgccggagatgctctaagagaaaatacattggtttcagaacatgcacaaagagaccaacgtgaaacacagtgtcaaatgaaggaagctgaacacatgtatcaaaacgaacaagataatgtgaacaaacacactgaacagcaggagtctctagatcagaaattatttcaactacaaagcaaaaatatgtggcttcaacagcaattagttcatgcacataagaaagctgacaacaaaagcaagatacaattgatattcattttcttgagaggaaaatgcaacatctctcctaaaagagaaaaatgaggagattttaattacaataaccatttaaaaaaccgttntatcatatgaaaagagaaagcngaaacngaagtagtttcaaaaatntaatacttgcaacttctggaagaaaagttaagnctatttggccttggttaatgctggatctagtggat

SEQ ID NO: 556 - DNA, 665 bp, Homo sapiens
  misc_feature (21)..(21): n is a, c, g, or t/u
  misc_feature (208)..(208): n is a, c, g, or t/u
  misc_feature (230)..(230): n is a, c, g, or t/u
  misc_feature (249)..(249): n is a, c, g, or t/u
  misc_feature (589)..(589): n is a, c, g, or t/u
  misc_feature (610)..(610): n is a, c, g, or t/u
  misc_feature (639)..(639): n is a, c, g, or t/u
  misc_feature (655)..(655): n is a, c, g, or t/u
ctattaaccatttttctttanataaagtgtatgtgttttctatgtttctcattctcaatattctcaacttataatgggtttatcaagacgtaatgccactgtaaactgaggagacccagtaccgtgggttgaaaatccctattctaaaatctgaagcttcaaaatttgaaacttttaaaatgcagacataatttttctcaatagtcanaacaaatatgagtattgactanaacaattgtcctctattanagtggtttctgttttatatttattgattaagatatatttcaaataaaactttattatgtcaatgtctgaaaaaataaattatcagtataatatatttaattgtaacaactggtaagatagaatattttcaatttacacaataacaggtagcatgtatgtcagatattatcccctgcttaggcaaatttataataagacatgattatgtctcatgaaaaaataaagcaatgtcaattgaaagttaaattgttctgcaccaactagaaaacacatcctgaagcataagggcaatgagagtcagaacagtcagagaaagctttatgaaaatggaaaatgtgtncaccaagtctgaatgaatganggatagatgaacaaaaactgaaaatggangaacagcctgaggaangcaaaaagat

SEQ ID NO: 557 - DNA, 770 bp, Homo sapiens
  misc_feature (170)..(170): n is a, c, g, or t/u
  misc_feature (214)..(214): n is a, c, g, or t/u
  misc_feature (242)..(242): n is a, c, g, or t/u
  misc_feature (307)..(307): n is a, c, g, or t/u
  misc_feature (489)..(489): n is a, c, g, or t/u
  misc_feature (568)..(568): n is a, c, g, or t/u
  misc_feature (630)..(630): n is a, c, g, or t/u
  misc_feature (691)..(691): n is a, c, g, or t/u
  misc_feature (751)..(751): n is a, c, g, or t/u
gtttttttttttttttttttttttgatacggagtctcgctctgtcgcccaggctggattgaatgatgtctgctgcatcatcagggtagatgggaatcctgtgcagctttatgcaattcgtgaacaagtaattcttcacactgttattttatgtctgtaggcttcaggaanaaatcatgaatttttcttctaaaataagtattctgttgacacanactattggtaagattttcaacataaggngatgctaggactggcctcctagcatgagttgtgagtaaagatctggtctgttgtttctccaaaanaagtttcttactgcttgtctctcatgagttttctgtttctgctttctctttttcatattgatatatacggttttttaaatggttattgtaattaaatatctcctcatttttctcttttaggagatgatgttgcattttcctctcaagaaaatgaatatcaattgttatcttgcttttgttgncagctttcttatgtgcatgaactaattgctgttgaagccacatatttttgctttgtagttgaaataatttctgatctanagactcctgctgttcaatgtgtttgttcacattatcttgttcgttttgaaacatgtgttcancttccttcatttgacactgggtttcacgttggctctttgtgcatgttctgaaacccatgtnttttctcttaaaaccatctccggcataattgaaaataatttttaggctttttgggatttncttttgagcttcaaaaaag

SEQ ID NO: 558 - DNA, 735 bp, Homo sapiens
  misc_feature (565)..(565): n is a, c, g, or t/u
  misc_feature (595)..(595): n is a, c, g, or t/u
  misc_feature (601)..(601): n is a, c, g, or t/u
gaaagagttagaagtgaaacaacaacttgaacaggctctcagaatacaagatatagaattgaagagtgtagaaagtaatttgaatcaggtttctcacactcatgaaaatgaaaattatctcttacatgaaaattgcatgttgaaaaaggaaattgccatgctaaaactggaaatagccacactgaaacaccaataccaggaaaaggaaaataaatactttgaggacattaagattttaaaagaaaagaatgctgaacttcagatgaccctaaaactgaaagaggaatcattaactaaaagggcatctcaatatagtgggcagcttaaagttctgatagctgagaacacaatgctcacttctaaattgaaggaaaaacaagacaaagaaatactagaggcagaaattgaatcacaccatcctagactggcttctgctgtacaagaccatgatcaaattgtgacatcaagaaaaagtcaagaacctgctttccacattgcaggagatgcttgtttgcaaagaaaaatgaatgttgatgtgagtagtaccgatatataacaatgaggngctccatcaaccactttctgaagctcaaangaaatncaaaagcctaaaaattaatctcaattatgcccgagatgctctaagaaaaaatacattggtttcagaacatgcccaagaggaccacgtggaacaaagtgtcaaatggaaggaagctggaacccatgtttcaaacc

SEQ ID NO: 559 - DNA, 664 bp, Homo sapiens
  misc_feature (547)..(547): n is a, c, g, or t/u
  misc_feature (556)..(556): n is a, c, g, or t/u
  misc_feature (594)..(594): n is a, c, g, or t/u
ctgccttcgagcctgccattgatatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttccagaaggatgtgtgtttacccaangcttgcgcntcaaaaagaaatagataaaataaatggaaaattagaangtagatatgctgctgaatttaaaacattctttgcaatgataagggcttctgttaaagaagggcttctgaa

SEQ ID NO: 560 - DNA, 636 bp, Homo sapiens
  misc_feature (426)..(426): n is a, c, g, or t/u
  misc_feature (432)..(432): n is a, c, g, or t/u
  misc_feature (556)..(556): n is a, c, g, or t/u
  misc_feature (599)..(599): n is a, c, g, or t/u
gtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctgcccatcaaaaagaaatagatnaaatanatggaaaattagaagggtctcctgttaaagatggtcttctgaaggctaactgcggaatgaaagtttctatttcaactaaagccttaagaattgatggacatgcaaactttcaaagcagagcctnccgagaagccatctgccttcgagcctgccattgaaatgcacangtctgttcccaaataaagcccttggaattgaagaatg

SEQ ID NO: 561 - DNA, 751 bp, Homo sapiens
  misc_feature (596)..(596): n is a, c, g, or t/u
  misc_feature (648)..(648): n is a, c, g, or t/u
  misc_feature (670)..(670): n is a, c, g, or t/u
  misc_feature (698)..(698): n is a, c, g, or t/u
  misc_feature (720)..(720): n is a, c, g, or t/u
aatttgaatcaggtttctcacactcatgaaaatgaaaattatctcttacatgaaaattgcatgttgaaaaaggaaattgccatgctaaaactggaaatagccacactgaaacaccaataccaggaaaaggaaaataaatactttgaggacattaagattttaaaagaaaagaatgctgaacttcagatgaccctaaaactgaaagaggaatcattaactaaaagggcatctcaatatagtgggcagcttaaagttctgatagctgagaacacaatgctcacttctaaattgaaggaaaaacaagacaaagaaatactagaggcagaaattgaatcacaccatcctagactggcttctgctgtacaagaccatgatcaaattgtgacatcaagaaaaagtcaagaacctgctttccacattgcaggagatgcttgtttgcaaagaaaaatgaatgttgatgtgagtagtacgatatataacaatgaggtgctccatcaaccactttctgaagctcaaaggaaatccaaaagcctaaaaattaatctcaattatgccggagatgctctaagagaaaatcattggtttcagaacatgcncaaagagaccaacgtgaaacacagtgtcaaatgaaggaagctgacacatgtntcaaaacgaacaagaataatgnggaccaaaccacactgaaccagcaggangtcttttagatccagaaatttntttcaaacttccaaagccaaaaaatttgtgg

SEQ ID NO: 562 - DNA, 671 bp, Homo sapiens
  misc_feature (417)..(417): n is a, c, g, or t/u
  misc_feature (497)..(497): n is a, c, g, or t/u
  misc_feature (570)..(570): n is a, c, g, or t/u
  misc_feature (595)..(595): n is a, c, g, or t/u
  misc_feature (604)..(604): n is a, c, g, or t/u
  misc_feature (618)..(618): n is a, c, g, or t/u
  misc_feature (631)..(631): n is a, c, g, or t/u
ctaaaatgcaaatctgatcatacaattttgcagctaaaaattctgcagtggttcctcaaggttttatgataaagtccaaactccttggcgtggtgtacagggtacttaggatctggacctttttgttgcttcacgtgttcacagggctgttctttggtttggaacacttctcccaggtgttaggactccttccccagtttctctctctctcccctttctgccccactccctggcttggattaagtctcccactgacgccaccctgtaggtatttatcacagtccctatcacataggattatctgtttctttacttgtctgtttctacctttaaaccatgaagtttttgaaggacgagtcaggggtttagtaatcttttagttcagttaaagatgactaatattggttaattgcttgntatgtattagcaacaatgcaaattcctggatgtgtaagtgattcatgggacattgccctgacctcattcttagatgaggngtagatgcagagacccatgtctctcgatttggggggaggcaaatgatggccttcttagccaagtccaatccantcctgcctatttttggatgggctgngaactaaanaaatggggttggcntttttaaattggntagaaaaaaatccgaagaataatattttggggacatggtg

SEQ ID NO: 563 - DNA, 722 bp, Homo sapiens
  misc_feature (208)..(208): n is a, c, g, or t/u
  misc_feature (343)..(343): n is a, c, g, or t/u
  misc_feature (364)..(364): n is a, c, g, or t/u
  misc_feature (551)..(551): n is a, c, g, or t/u
  misc_feature (668)..(668): n is a, c, g, or t/u
  misc_feature (677)..(677): n is a, c, g, or t/u
  misc_feature (689)..(689): n is a, c, g, or t/u
catattgatatatacggttttttaaatggttattgtaattaaatatctcctcatttttctcttttaggagatgatgttgcattttcctctcaagaaaatgaatatcaattgttatcttgcttttgttgtcagctttcttatgtgcatgaactaattgctgttgaagccacatatttttgctttgtagttgaaataatttctgatctanagactcctgctgttcagtgtgtttgttcacattatcttgttcgttttgatacatgtgttcagcttccttcatttgacactgtgtttcacgttggtctctttgtgcatgttctgaaaccaatgtattttctcttanagcatctccggcataattganattaatttttaggcttttggatttcctttgagcttcaaaaagtggttgatggagcacctcattgttatatatcgtactactcacatcaacattcatttttctttgcaaacaagcatctcctgcaatgtggaaagcaggttcttgactttttcttgatgtcacaatttgatcatggtcttgtcagcanaagccagtctagggatggtgtgattcaatttctgcctctagtatttctttggcttggttttccttcaatttaaaaagtgaacattggggttctcaagctttcaaaactttaagctgnccccttttnttgaaaagcccntttaagttaaaggattccctctttcaagtttta

SEQ ID NO: 564 - DNA, 1158 bp, Homo sapiens
  misc_feature (115)..(115): n is a, c, g, or t/u
  misc_feature (117)..(117): n is a, c, g, or t/u
atgattacaccctatggttatggaaaaaaacgaatattcatatttagtattatgacctaagtgtatatccaagctgatcaattcataacacttcagtgatgagatgtcagttgtncnttcggctgaactctcatcataactatgtacctttccaaagataggctatattaaagaacaggatgaatggaataatataagtgattctaatgtgtttcattaaagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctgcgcatcaaaaagaaatagataaaataaatggaaaattagaaggtagatatgctgctgaatttagaacattctctgcaatgataaggtctcctgttaaagatggtcttctgaaggctaactgcggaatgaaagtttctattccaactaaagccttagaattgatggacatgcaaactttcaaagcagaacctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctgcgcatcaaaaagaaatagataaaataaatggaaaattagaagccattagggatggaagcacctgaccatggagagctgtgttctatttgcaatagggtctcctgttaaaagatggtcttctgaaggctaactgcggaatgaaagtttctattccaactaaagccttaaaattgatggacatgcaaactttcaaagcagaacctcccgagaagccatctgccttcgagccctgccattgaaatgccaaaagtctggttccaaataaagcccttggaattgaagaatggaacaaacctttgggagccggatggagatacttcccttcc

SEQ ID NO: 565 - DNA, 766 bp, Homo sapiens
  misc_feature (115)..(115): n is a, c, g, or t/u
  misc_feature (117)..(117): n is a, c, g, or t/u
  misc_feature (653)..(653): n is a, c, g, or t/u
  misc_feature (677)..(677): n is a, c, g, or t/u
  misc_feature (717)..(717): n is a, c, g, or t/u
  misc_feature (740)..(740): n is a, c, g, or t/u
  misc_feature (752)..(752): n is a, c, g, or t/u
atgattacaccctatggttatggaaaaaaacgaatattcatatttagtattatgacctaagtgtatatccaagctgatcaattcataacacttcagtgatgagatgtcagttgtncnttcggctgaactctcatcataactatgtacctttccaaagataggctatattaaagaacaggatgaatggaataatataagtgattctaatgtgtttcattaaagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctgcgcatcaaaaagaaatagataaaataaatggaaaattagaaggtagatatgctgctgaatttagaacattctctgcaatgataaggtctcctgttaaagatggtcttctgaaggctaactgcggaatgaaagtttctattccaactaaagccttagaattgatggacatgcaaactttcaaagcagaacctcccgagaagccatctgccttcgagcctgncattggaaagccaaaagtctgttnccaaataaaagcctttggaattggaagaatggaccaaccnttgggagcccgatgagaatactncccttcagaatnccaaccaaaagggc

SEQ ID NO: 566 - DNA, 833 bp, Homo sapiens
  misc_feature (631)..(631): n is a, c, g, or t/u
  misc_feature (674)..(674): n is a, c, g, or t/u
  misc_feature (710)..(710): n is a, c, g, or t/u
  misc_feature (723)..(723): n is a, c, g, or t/u
  misc_feature (726)..(726): n is a, c, g, or t/u
  misc_feature (739)..(739): n is a, c, g, or t/u
  misc_feature (774)..(774): n is a, c, g, or t/u
  misc_feature (781)..(781): n is a, c, g, or t/u
gatactcccatcagaatccaaacaaaaggactatgaagaaagttcttgggattctgagagtctctgtgagactgtttcacagaaggatgtgtgtttacccaaggctgcgcatcaaaaagaaatagataaaataaatggaaaattagaaggtagatatgctgctgaatttagaacattctctgcaatgataaggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctgcgcatcaaaaagaaatagataaaataaatggaaaattagaagccattagggatggaagcacctgaccatggagagctgtgttctatttgcaatagggtctcctgttaaaagatggtcttctgaangctaactgcggaatgaaagtttctattccaactaaagccttanaattgatggacatgcaaactttcaaagcagaacctnccgagaagccatntgncttcgagccctgncattgaaatgccaaaagtctggttccaaataaagnccttggnaattgaagaatggaacaaacctttgggagccggatggagatacttcccttcc

SEQ ID NO: 567 - DNA, 758 bp, Homo sapiens
  misc_feature (290)..(290): n is a, c, g, or t/u
  misc_feature (364)..(364): n is a, c, g, or t/u
  misc_feature (540)..(540): n is a, c, g, or t/u
  misc_feature (571)..(571): n is a, c, g, or t/u
  misc_feature (592)..(592): n is a, c, g, or t/u
  misc_feature (623)..(623): n is a, c, g, or t/u
  misc_feature (636)..(636): n is a, c, g, or t/u
  misc_feature (647)..(647): n is a, c, g, or t/u
  misc_feature (651)..(651): n is a, c, g, or t/u
  misc_feature (667)..(667): n is a, c, g, or t/u
  misc_feature (680)..(680): n is a, c, g, or t/u
  misc_feature (697)..(697): n is a, c, g, or t/u
  misc_feature (712)..(712): n is a, c, g, or t/u
  misc_feature (717)..(717): n is a, c, g, or t/u
catattgatatatacggttttttaaatggttattgtaattaaatatctcctcatttttctcttttaggagatgatgttgcattttcctctcaagaaaatgaatatcaattgttatcttgcttttgttgtcagctttcttatgtgcatgaactaattgctgttgaagccacatatttttgctttgtagttgaaataatttctgatctagagactcctgctgttcagtgtgtttgttcacattatcttgttcgttttgatacatgtgttcagcttccttcatttgacactgngtttcacgttggtctctttgtgcatgttctgaaaccaatgtattttctcttagagcatctccggcataattganattaatttttaggcttttggatttcctttgagcttcagaaagtggttgatggagcacctcattgttatatatcgtactactcacatcaacattcatttttctttgcaaacaagcatctcctgcaatgtggaaagcaggttcttgactttttcttgatgtcacaatttgatcatggncttgtcagcagaagccagtctaggatggggngattcaatttctgcccctagnatttctttggcttggttttccttcaatttanaagtgagcattgngttctcagctnttanaactttaagctggccnctatattggagangcccctttaagttaaangattcccctttcagntttangggccatctgaaggtcaaccttctttttcttttaaaaacct

SEQ ID NO: 568 - DNA, 771 bp, Homo sapiens
  misc_feature (568)..(568): n is a, c, g, or t/u
  misc_feature (691)..(691): n is a, c, g, or t/u
  misc_feature (699)..(699): n is a, c, g, or t/u
  misc_feature (743)..(743): n is a, c, g, or t/u
ggcatgacttggtcatcttattaaatacaacttctttcctaatacggccgctttctcttactgatagtaggatatttctgctttagttattgtcaccttaaatatattttcaatgttgaaatcctcacagcatgtttgatgaaatctagttttcaaattttcttagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctgcgcatcaaaaagaaatagataaaataaatggaaaattagaaggtagatatgctgctgaatttagaacattctctgcaatgataaggnctcctgttaaaagatggtcttctgaaggctaactgcggaaatgaaagtttctattccaactaaagccttaaaaatggatggacatgccaactttcaaagcagaagcctcccgagaagcccttntggccttngagcctggccttggaaatgcaaaaagtctggttccaaataaagnccttgggaattggaagaaatgaaccaac

SEQ ID NO: 569 - DNA, 756 bp, Homo sapiens
  misc_feature (12)..(12): n is a, c, g, or t/u
  misc_feature (25)..(25): n is a, c, g, or t/u
  misc_feature (40)..(40): n is a, c, g, or t/u
  misc_feature (183)..(183): n is a, c, g, or t/u
  misc_feature (191)..(191): n is a, c, g, or t/u
  misc_feature (193)..(193): n is a, c, g, or t/u
  misc_feature (253)..(253): n is a, c, g, or t/u
  misc_feature (276)..(276): n is a, c, g, or t/u
  misc_feature (295)..(295): n is a, c, g, or t/u
  misc_feature (411)..(411): n is a, c, g, or t/u
  misc_feature (424)..(424): n is a, c, g, or t/u
  misc_feature (465)..(465): n is a, c, g, or t/u
  misc_feature (490)..(490): n is a, c, g, or t/u
  misc_feature (502)..(502): n is a, c, g, or t/u
  misc_feature (537)..(537): n is a, c, g, or t/u
  misc_feature (549)..(549): n is a, c, g, or t/u
  misc_feature (555)..(555): n is a, c, g, or t/u
  misc_feature (568)..(568): n is a, c, g, or t/u
  misc_feature (579)..(579): n is a, c, g, or t/u
  misc_feature (596)..(597): n is a, c, g, or t/u
  misc_feature (645)..(645): n is a, c, g, or t/u
  misc_feature (651)..(651): n is a, c, g, or t/u
  misc_feature (653)..(653): n is a, c, g, or t/u
  misc_feature (655)..(655): n is a, c, g, or t/u
  misc_feature (663)..(663): n is a, c, g, or t/u
  misc_feature (667)..(668): n is a, c, g, or t/u
  misc_feature (675)..(675): n is a, c, g, or t/u
  misc_feature (679)..(679): n is a, c, g, or t/u
  misc_feature (682)..(682): n is a, c, g, or t/u
  misc_feature (685)..(685): n is a, c, g, or t/u
  misc_feature (692)..(692): n is a, c, g, or t/u
  misc_feature (698)..(698): n is a, c, g, or t/u
  misc_feature (700)..(700): n is a, c, g, or t/u
  misc_feature (718)..(718): n is a, c, g, or t/u
  misc_feature (731)..(731): n is a, c, g, or t/u
  misc_feature (739)..(739): n is a, c, g, or t/u
  misc_feature (744)..(744): n is a, c, g, or t/u
ccttcaatttanaagtgagcattgngttctcagctatcanaactttaagctgcccactatattgagatgcccttttagttaatgattcctctttcagttttagggtcatctgaagttcagcattcttttcttttaaaatcttaatgtcctcaaagtatttattttccttttcctggtattggngtttcagngnggctatttccagttttagcatggcaatttcctttttcaacatgcaattttcatgtaaganataattttcattttcatgagtgngagaaacctcacactgcanagctcttgttcccatttaactttttggttctctaactgggattttatttcttttgcttctgacagtttctttttcagtacacaaaacttctttttcatttgttccatttttcctgncgttgttcacagngatctttttgaagttcccttgctctttcacaagaatgaacngtatccaaaatttttgataggctanttgaatcttctnattttccacttattttatccatttctttttgatgngaaccttggggncacccnccatccttcttgngaacaagtctncaccgaggacctttcannaaaccccaaaaattttcttcaacccttcttttgttttgattcttgaangggaanancnggaaccgnctcnnaatggtngggncanttncttaaantccaangncttttatttgggaaacanacctttgcatttnaattggcngggcnccaaaggcaaaa

SEQ ID NO: 570 - DNA, 741 bp, Homo sapiens
  misc_feature (600)..(600): n is a, c, g, or t/u
  misc_feature (606)..(606): n is a, c, g, or t/u
  misc_feature (643)..(643): n is a, c, g, or t/u
  misc_feature (646)..(646): n is a, c, g, or t/u
  misc_feature (658)..(658): n is a, c, g, or t/u
  misc_feature (666)..(666): n is a, c, g, or t/u
  misc_feature (670)..(670): n is a, c, g, or t/u
  misc_feature (712)..(712): n is a, c, g, or t/u
  misc_feature (718)..(718): n is a, c, g, or t/u
gaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctgcgcatcaaaaagaaatagataaaataaatggaaaattagaaggtagatatgctgctgaatttggaacattctctgcaatgataaggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatctcccatcagaatccaaacaaaaggactatgaaaaaagttcttgggattctgagagtctctgtgagactgtttcacagaaaggatgtgtgtttaccccaagntgcgcntcaaaaggaaattgattaaattaatgggaaaatttanaanggtcttctggtnaaaaaggncttntgaaggctaactgcggaatgaaagttctattccacttaaagnccttanaaatggtgggcatgcaaactttt

SEQ ID NO: 571 - DNA, 702 bp, Homo sapiens
  misc_feature (208)..(208): n is a, c, g, or t/u
  misc_feature (546)..(546): n is a, c, g, or t/u
  misc_feature (573)..(573): n is a, c, g, or t/u
  misc_feature (588)..(588): n is a, c, g, or t/u
  misc_feature (597)..(597): n is a, c, g, or t/u
  misc_feature (608)..(608): n is a, c, g, or t/u
  misc_feature (644)..(644): n is a, c, g, or t/u
  misc_feature (657)..(657): n is a, c, g, or t/u
catattgatatatacggttttttaaatggttattgtaattaaatatctcctcatttttctcttttaggagatgatgttgcattttcctctcaagaaaatgaatatcaattgttatcttgcttttgttgtcagctttcttatgtgcatgaactaattgctgttgaagccacatatttttgctttgtagttgaaataatttctgatctanagactcctgctgttcagtgtgtttgttcacattatcttgttcgttttgatacatgtgttcagcttccttcatttgacactgtgtttcacgttggtctctttgtgcatgttctgaaaccaatgtattttctcttagagcatctccggcataattgagattaatttttaggcttttggatttcctttgagcttcagaaagtggttgatggagcacctcattgttatatatcggactactcacatcaacattcatttttctttgcaaacaagcatctcctgcaatgtggaaagcaggttcttgactttttcttgatgtcacaatttgatcatgggccttgnaccagcaaaaaccagtctaggaatggnggggatcaatttccngcctctagnatttctttggncttggtttccctcaatttaaaaagtgaagcattggnggtcctcaacctnttcaaaacctttaaccgcccccctttttggaaaagccccttttag

SEQ ID NO: 572 - DNA, 1030 bp, Homo sapiens
aacaaaaggactatgaagaaagttcttgggattctgagagtctctgtgagactgtttcacagaaggatgtgtgtttacccaaggctacacatcaaaaagaaatagataaaataaatggaaaattagaagagtctcctgataatgatggttttctgaaggctccctgcagaatgaaagtttctattccaactaaagccttagaattgatggacatgcaaactttcaaagcagagcctcccgagaagccatctgccatttagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagattcaactagcctatcaaaaatcttggatacagttcattcttgtgaaagagcaagggaacttcaaaaagatcactgtgaacaacgtacaggaaaaatggaacaaatgaaaaagaagttttgtgtactgaaaaagaaactgtcagaagcaaaagaaataaaatcacagttagagaaccaaaaagttaaatgggaacaagagctctgcagtgtgagggttctcacactcatgaaaatgaaaattatctcttacatgaaaattgcatgttgaaaaaggaaattgcctgcttaaactgggaataccccactggaaccccatcccggaaaagggaaataatactttgaggactttagattttaaagaaaagaatgctggacttcgatgaccttaactggaagagggatctttcttaaagggtttcatttatgggcagcttaagtttgatactggacacatgctccttttaattgagggaaacagacaagaatcttaggggaaatgattcccctcttactggtttgtggcaaaccttgtcaattggctca

SEQ ID NO: 573 - DNA, 782 bp, Homo sapiens
  misc_feature (59)..(59): n is a, c, g, or t/u
gacttgaagacagtcaaagagaaggatgacattctgtttgaagaccttcaagacaatgngaatgagaatggtgaaggtgaaatagaagatgaggaggaggagggttatgatgatgatgatgatgactgggactgggatgaaggagttggaaaactcgccaagggttatgtctggaatggaggaagcaacccacaggcaaatcgacagacctccgacagcagttcagccaaaatgtctactccagcagacaaggtcttacggaaatttgagaataaaattaatttagataagctaaatgttactgattccgtcataaataaagtcaccgaaaagtctagacaaaaggaagcagatatgtatcgcatcaaagataaggcagacagagcaactgtagaacaggtgttggatcccagaacaagaatgattttattcaagatgttgactagaggaatcataacagagataaatggctgcattagcacaggaaaagaagctaatgtatccatgctagcacagcaaatggagagagcagagcaatcaaaatttataaaacttctattttggtgttcaaagatcgggataaatatgtaagtggagaattcagatttcgtcatggctattgtaaaggaaaccctaagaaaatggggaaaacttgggccgaaaaagaaaatgaaggacttaatcaggcttaaccacaagcagaaaataccattgttccagaacccaataatgcttaaaaaatcatgttccttggccatgaagttttcattcggggaaaaaaa

SEQ ID NO: 574 - DNA, 776 bp, Homo sapiens
  misc_feature (515)..(515): n is a, c, g, or t/u
  misc_feature (535)..(535): n is a, c, g, or t/u
  misc_feature (552)..(552): n is a, c, g, or t/u
  misc_feature (576)..(576): n is a, c, g, or t/u
  misc_feature (579)..(579): n is a, c, g, or t/u
  misc_feature (598)..(598): n is a, c, g, or t/u
  misc_feature (631)..(631): n is a, c, g, or t/u
  misc_feature (645)..(645): n is a, c, g, or t/u
  misc_feature (650)..(650): n is a, c, g, or t/u
  misc_feature (655)..(655): n is a, c, g, or t/u
  misc_feature (672)..(672): n is a, c, g, or t/u
  misc_feature (693)..(693): n is a, c, g, or t/u
  misc_feature (695)..(695): n is a, c, g, or t/u
atttagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagattcaactagcctatcaaaaatcttggatacagttcattcttgtgaaagagcaagggaacttcaaaaagatcactgtgaacaacgtacaggaaaaatggaacaaatgaaaaagaagttttgtgtactgaaaaagaaactgtcagaagcaaaagaaataaaatcacagttagagaaccaaaaagttaaatgggaacaagagctctgcagtgtgagggttctcacactcatgaaaatgaaaattatctcttacatgaaaattgcatgttgaaaaaggaaattgcntgcttaaactgggaataccncactggaaccccatccnggaaaagggaaataatactttgangantttagattttaaagaaaanaatgctggacttcgatgaccttaactggaaganggatctttcttaangggtntcatntatgggcagcttaagtntgatactggacacatgctccntntaattgagggaaacagacaagaatcttaggggaaatgattcccctcttactggtttgtggcaaaccttgtcaattggctca

SEQ ID NO: 575 - DNA, 741 bp, Homo sapiens
  misc_feature (279)..(279): n is a, c, g, or t/u
  misc_feature (652)..(652): n is a, c, g, or t/u
  misc_feature (662)..(662): n is a, c, g, or t/u
  misc_feature (687)..(687): n is a, c, g, or t/u
  misc_feature (692)..(692): n is a, c, g, or t/u
  misc_feature (712)..(712): n is a, c, g, or t/u
gacttaaagtgatgatttaatgctgtttcatgtattcagaggtgtacaaccatcacaatcaatttcagagcatcctcataagtgcacccaaaagaaaccctgtacttattagcagtgaatctctatttcctcgcaaacctcctcccggtcctaggcaagcactcatctactttctctctctcaaacagatttgcctattctggacatttcatacagatcaaatcatgcaatatgaaaccttttgcaattggcgtctttaattttacaagtcttcaaggngcatttaccttgtaggtgtttcattacttcattttatttacttatttatgtatttagaaacatggtttgctctgtcacccaggctggagtgcagtgatgcataatcatagctcactccagccttgaatacctgggctcaagcaatcctcccaccccggcctcctgagtagctgtggcaggagaatggcgtgaacctgggaggcagagtttgcagtgagccgagattgcgccactgcactccagcctgagtgacagagcgagattctggttggattgaatgatgtctgctgcatcatcagggtagatgggaatcctgtgcagctttatgcaattcgtgaacaagtaattcttcacactggtattttatgtctgnagggcttcangaagaaatcatgaatttttcttctnaaaanaagtattctggtgaaaccanactattgggtaagaatttcaacataaagg

SEQ ID NO: 576 - DNA, 609 bp, Homo sapiens
  misc_feature (448)..(448): n is a, c, g, or t/u
  misc_feature (469)..(469): n is a, c, g, or t/u
  misc_feature (517)..(517): n is a, c, g, or t/u
  misc_feature (548)..(548): n is a, c, g, or t/u
  misc_feature (565)..(565): n is a, c, g, or t/u
  misc_feature (569)..(569): n is a, c, g, or t/u
  misc_feature (571)..(571): n is a, c, g, or t/u
  misc_feature (579)..(579): n is a, c, g, or t/u
  misc_feature (587)..(587): n is a, c, g, or t/u
gtgagactgtttcacagaaggatgtgtgtgtacccaaggctacacatcaaaaagaaatggataaaataagtggaaaattagaagattcaactagcctatcaaaaatcttggatacagttcattcttgtgaaagagcaagggaacttcaaaaagatcactgtgaacaacgtacaggaaaaatggaacaaatgaaaaagaagttttgtgtactgaaaaagaaactgtcagaagcaaaagaaataaaatcacagttagagaaccaaaaagttaaatgggaacaagagctctgcagtgtgagattgactttaaacccagaagaagagaagagaagaaatgccgatatattaaatgaaaaaattagggaagaattaggaagaatcgaagagcacataggaaagagttagaagtgaaacaacacttgaacaggctctcagaatacaagatatanaattgaagagtgtagaaagtnatttgaatcagggttctcacactcatgaaaatgaaaattatctcttcntgaaaattgcatgttgaaaaagggaattgcntgcttaaactggaaatngccncnctggaacncccatccnggaaaagggaaataaatctttg

SEQ ID NO: 577 - DNA, 739 bp, Homo sapiens
  misc_feature (15)..(15): n is a, c, g, or t/u
  misc_feature (205)..(205): n is a, c, g, or t/u
  misc_feature (287)..(287): n is a, c, g, or t/u
  misc_feature (589)..(589): n is a, c, g, or t/u
  misc_feature (596)..(596): n is a, c, g, or t/u
  misc_feature (605)..(605): n is a, c, g, or t/u
  misc_feature (647)..(647): n is a, c, g, or t/u
  misc_feature (652)..(652): n is a, c, g, or t/u
  misc_feature (710)..(710): n is a, c, g, or t/u
attgatatatacggntttttaaatggttattgtaattaaatatctcctcatttttctcttttaggagatgatgttgcattttcctctcaagaaaatgaatatcaattgttatcttgcttttgttgtcagctttcttatgtgcatgaactaattgctgttgaagccacatatttttgctttgtagttgaaataatttctgatctanagactcctgctgttcagtgtgtttgttcacattatcttgttcgttttgatacatgtgttcagcttccttcatttgacactgngtttcacgttggtctctttgtgcatgttctgaaaccaatgtattttctcttagagcatctccggcataattgagattaatttttaggcttttggatttcctttgagcttcagaaagtggttgatggagcacctcattgttatatatcgtactactcacatcaacattcatttttctttgcaaacaagcatctcctgcaatgtggaaagcaggttcttgactttttcttgatgtcacaatttgatcatggtcttgtacagcagaagccagtctaggatggtgtgattcaatttctgcctctangatttcnttggcttgnttttccttcaatttaaaaagtgagcattgggttctcaagctntcaanaacttttaactggcccactttattggagatgccccttttaagttaaatggattccctntttcagttttaaggggcatcctggaagtc

SEQ ID NO: 578 - DNA, 625 bp, Homo sapiens
  misc_feature (59)..(59): n is a, c, g, or t/u
  misc_feature (511)..(511): n is a, c, g, or t/u
gacttgaagacagtcaaagagaaggatgacattctgtttgaagaccttcaagacaatgngaatgagaatggtgaaggtgaaatagaagatgaggaggaggagggttatgatgatgatgatgatgactgggactgggatgaaggagttggaaaactcgccaagggttatgtctggaatggaggaagcaacccacaggcaaatcgacagacctccgacagcagttcagccaaaatgtctactccagcagacaaggtcttacggaaatttgagaataaaattaatttagataagctaaatgttactgattccgtcataaataaagtcaccgaaaagtctagacaaaaggaagcagatatgtatcgcatcaaagataaggcagacagagcaactgtagaacaggtgttggatcccagaacaagaatgattttattcaagatgttgactagaggaatcataacagagataaatggctgcattagcacaggaaaagaagctaatgtatccatgctanccacagcaaatggagagagcagagcaatcaaaatttattaaacttctattttggtgttcaaagatcgggattaaatatgtaagtggagaattcaagatttcgtcatggctattg

SEQ ID NO: 579 - DNA, 686 bp, Homo sapiens
atcaatgtcagggtccgtggtgtgtttcttggggcgggcatggtctccctgctcttcagagtctgtgtcagagcactcagagcttccaatatcttctgaatcagaacaagtcctttcctccacttgattttctaggagtgcagggaccttctgaactcctgacaaatctttcttcaatcctgtaacagtctggtatagaatattatcttgttgggcattcatggccatgtcctcttccttcaatttcataattatgtccatatccctctcataatttttcacttcattcaaggttctaggaatatatgctcgcttaaacacctcttcatccacatgatcttggctagaccgttcttccttggtcctttgagatgctatttccatggcctttgagagataagcatccatgttctcatgtgtaatggatggatctgtgacaaattcaaagagctcccgcacagtcatgacagcaacactgtgcctcataaagaaatcattgacgttggcgcaatcctttctcaagaactccaaggcatgtgggtggtcgtgctccacggactgagacacgtcaatgatatacacgcctccaccgtggtacagcatgttaaattcactgagatctgcatggacaaagtctggcatcctgatacattcttctcatgtactgaatgacctgcaggtcaact

SEQ ID NO: 580 - DNA, 701 bp, Homo sapiens
  misc_feature (408)..(408): n is a, c, g, or t/u
  misc_feature (560)..(560): n is a, c, g, or t/u
  misc_feature (590)..(590): n is a, c, g, or t/u
  misc_feature (629)..(629): n is a, c, g, or t/u
ctgaacctgatcagaaaccggaacctgtggacaaagtggctgccatgagagagttccgggtgttgcacactgccctgcacagcagctcctcttacagggaggcggtctttaagatgctcagcaataaggagtctctggatcagatcattgtggccaccccaggcctcagcagtgaccctattgctcttggggttctccaggacaaggacctcttctctgtcttcgctgatcccaatatgcttgatacgttggtgcctgctcacccagccctcgtcaatgccattgtcctggttctgcactccgtagcaggcagtgccccaatgcctgggactgactcctcttcccggagcatgccctccagctcataccgggatatgccaggtggcttcctgtttgaagggctctcanatgatgaggatgactttcacccaaacaccaggtccacaccctctagcagtactcccagctcccgccagcctcctggggtacaagtggagctgctgggccccggcccatcacccaaagtgagctggccaccgccttggccctggccagcactncggagagcaagcttttaaaacaccgacttnctggcaccccaagggtcatttccttaaggaccttacccnatgtccctctggtgtccagtcaaggggacgcccattaaccaatgatctttttaagcccaagcccttacagca

SEQ ID NO: 581 - DNA, 696 bp, Homo sapiens
  misc_feature (271)..(271): n is a, c, g, or t/u
  misc_feature (343)..(343): n is a, c, g, or t/u
  misc_feature (472)..(472): n is a, c, g, or t/u
  misc_feature (524)..(524): n is a, c, g, or t/u
  misc_feature (618)..(618): n is a, c, g, or t/u
  misc_feature (629)..(629): n is a, c, g, or t/u
  misc_feature (634)..(634): n is a, c, g, or t/u
  misc_feature (680)..(680): n is a, c, g, or t/u
gagagttgaccatcaggtatattggggaagggagagatggaggcaccttcatgagtgcctcccaagggcagtagcctctgcaacttgctgggggttcaggggaagcagggagttcatggggctcctccagcaaagatgagctccagggctgcttggatgtccccaccggtggcctgcagggcccgcaggctcagctcatcgtcctggatgcccatgtcacgtagctgctgcagctggggctgccactggctctgaaggctgggctgcccanaggcctgaagggcatgctgtagggcttggctgaagagatcattggtgatgggcgtccctgactggacaccanaggacattggtgaggtccctgaggaatgaccctgggtgccaggagtcggtgtgtgagagctgctctccggagtgctggccagggccaaggcggtggccagctcactctgggtgatgggccggggcccancagctccactgtaccccagggaggctgggcgggagctgggagtactgctaanagggtgtggacctggtgtttgggtgaaagtcatcctcatcatctgagaacccttcaaacaggaagcccctggcatatcccggtattagctgganggcatgctccnggaanaggaatcaatcccaggcattggggccctgcctgcttccgagtgcanaaccaggaacaatggc

SEQ ID NO: 582 - DNA, 689 bp, Homo sapiens
  misc_feature (418)..(418): n is a, c, g, or t/u
  misc_feature (588)..(588): n is a, c, g, or t/u
  misc_feature (603)..(603): n is a, c, g, or t/u
  misc_feature (616)..(616): n is a, c, g, or t/u
  misc_feature (661)..(661): n is a, c, g, or t/u
gcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagccgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctnccaggagcagctgcgcaaactgcaggaacgggtggaacgctgtgccaaggaggccgagaagacaaaagctcagtatgagcagacgctggcagagctgcatcgctacactccacgctacatggaggacatggaacaagcctttgagaccttgcaggcccgccgagcgccancggcttcttttcttnaaggatatgctgntcaccttacaccaacacctggacctttttcagcagtgagaagttncatgaaacttcacccgtgacttgcacca

SEQ ID NO: 583 - DNA, 702 bp, Homo sapiens
  misc_feature (580)..(580): n is a, c, g, or t/u
  misc_feature (605)..(605): n is a, c, g, or t/u
  misc_feature (678)..(678): n is a, c, g, or t/u
  misc_feature (685)..(685): n is a, c, g, or t/u
  misc_feature (699)..(699): n is a, c, g, or t/u
ggtgtttttgtttttgtgtgtgggtgtgtgtcaagttttaatacacgctagaacaagccacaagagggtgctgctaggccagaactacactcaccccaagcccaccccaggaaccccaaagcagaggtcaggaactgagtccacagctcctggggaggcccaggcacccctgaacgcttctgtcacctctgacctcccatcttgccctcagcctagactcgtcccttccctaccagtcccttccctagacaaaggcccctcccctccctgggtcccaggacttcctccctcaagggacagaggagcagccagagagcgacggttcagggccctgagggtccggctctccaggagaagctgggctctgaaccagggtgggtaaacgttgcagaagggctgtcaggacactcaggcgcccacacactccacgtagttggcagggtacaggccaatgcggccactctgcaactggccttggcaccagccctgctcgtcctcctcactcatcttcagcagctcctcccctgctcggaagctcagctcatcagcttcctggccagcgtagtcatagagtgccctncccgaaccccggtgggagcctttcngggactctcttcatctgaccactcctcatcctgccccgtgcctggggaccccgggactggggtggggggcggnggcatcnttgtaggccaatgnttg

SEQ ID NO: 584 - DNA, 647 bp, Homo sapiens
  misc_feature (610)..(610): n is a, c, g, or t/u
  misc_feature (631)..(631): n is a, c, g, or t/u
ccgcccctcccgatttcctccgggctacaggcgacagagctgagccaagcgtttactgggcagctgttacgctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagagcaccttggaacatttcaagaggtggctccagccagataaagtagccgtcagcacagaggaggtccagtatctgattcctccagagtcacaggttgagaaaccagtggcccgaggacgaaccaccanccgggggacaagccagcagcngcagaaacagttaatt

SEQ ID NO: 585 - DNA, 712 bp, Homo sapiens
  misc_feature (440)..(440): n is a, c, g, or t/u
  misc_feature (482)..(482): n is a, c, g, or t/u
  misc_feature (561)..(561): n is a, c, g, or t/u
  misc_feature (594)..(594): n is a, c, g, or t/u
  misc_feature (610)..(611): n is a, c, g, or t/u
  misc_feature (631)..(631): n is a, c, g, or t/u
  misc_feature (643)..(643): n is a, c, g, or t/u
  misc_feature (650)..(650): n is a, c, g, or t/u
  misc_feature (665)..(665): n is a, c, g, or t/u
  misc_feature (684)..(684): n is a, c, g, or t/u
  misc_feature (696)..(696): n is a, c, g, or t/u
  misc_feature (704)..(704): n is a, c, g, or t/u
actttcacatttgatctttagcagacttctaacctgcagagacagagctcagccaagctgtgagacacagaggaaagcagcattttgatccagtgtgcactgggtcagtcacttcatccgagacagtcacacatgccagccccaggtaagtccctgggggcttgcagctgttttctttgtggagtggaaatttgggttttttccttcagtggatttctccctgctgctgtcactgagctccacgctgctcgctctggacccgagacagctgctcggcgtgtgtgtgtgtgtgtgtgtgtgtgtgtgtgtgtgtgtgtgtgtgtaatttactgttctgctgctgctggcttgtccccggctgctggctcgtcctcggccactggcttctcaacctgtgactctggaggaatcagatactggacctcctctgtgctgacggntactttatctggctggagccacctcttgaaatgttccaaggngctctcatcagaatcaagtccatccacaaaaaactctgaagctaacttctcctggaggaaccgatcccagcatttcttnttggcttgggccaaagttcgaagcatgtccttngaagtcacttctgatnnaaacctttgattcttcttancttcttctctanaaagctnaatcacctttgaatnctggaaggggacccaaggntttacagctggntggacagnaaaattag

SEQ ID NO: 586 - DNA, 851 bp, Homo sapiens
  misc_feature (733)..(733): n is a, c, g, or t/u
  misc_feature (736)..(736): n is a, c, g, or t/u
  misc_feature (755)..(755): n is a, c, g, or t/u
  misc_feature (787)..(787): n is a, c, g, or t/u
  misc_feature (806)..(807): n is a, c, g, or t/u
accggctctgcgggcgccaccaggcccagaccaagctactaccagaagttgaattctaataattagctattttataaaggtaacgagaaaaaatacactatgtctgatgaagtttttagcaccactttggcatatacaaagagtccaaaagttaccaaaagaactactttccaggatgagctaataagagcaattacagctcgctcagccagacaaaggagttctgaatactcagatgactttgacagtgatgagattgtttctttaggtgatttttctgacacttcagcagatgaaaattcagttaataaaaaaatgaatgactttcatatatcagatgatgaagaaaagaatccttcaaaactattgtttttgaaaaccaataaatcaaacggtaacataaccaaagatgagccagtgtgtgccatcaaaaatgaagaggaaatggcacctgatgggtgtgaagacattgttgtaaaatctttctctgaatctcaaaataaggatgaggaatttgaaaaagacaaaataaaaatgaaacctaaacccagaattctttcaattaaaagcacatcttcagaaaacaacagccttgacacagatgatcactttaaaccatcacctcggccaagggagtatgttgaaaaagaaaagtcacatggagggagaaggatggactagaagataaagaaactgccctcagtgaagaaattggagttacattctgcccttnttnccttcaacgccgaatggcntacaattagaagctgagaaaaaagcattcttntgaaaaaccttgatcctgnnggatctgctttacaagtctagcatcatcatcctttaaacaaatt

SEQ ID NO: 587 - DNA, 675 bp, Homo sapiens
  misc_feature (387)..(387): n is a, c, g, or t/u
  misc_feature (485)..(485): n is a, c, g, or t/u
  misc_feature (608)..(608): n is a, c, g, or t/u
  misc_feature (631)..(631): n is a, c, g, or t/u
  misc_feature (654)..(654): n is a, c, g, or t/u
gcttgaaaaaagcttcctttttttcattccatttctcaacagcagttaaattatctttctttttctcggcaacagtttcctcctctttctgtttctttgctctttcatattctctctcctttctatttttctctttaagatattccatctttttctctttccatttttcaaaagcttgtagtgcttctccttttcttgcagcattttcttcttcagttttcctcttgtttttttcttcaagcctctttttggcagctattttctttgcttccttttctttcatagccttccaggcctcaaatgatgctaatgcttcttctcttttagcagcttttttctgttcattttggatccttaagttttcactttcaattctttttattctgngcatttcatgtaaatatacatttttcttttctaaccactcctgataaacagctgcccttatgttatctgctctatcaggttctatgctctgtttctgngaaggtttttggccaagacttttaaagtccctaaatagtgagaagaggtagttgtcggtggagtctccttttagaactaagatttcttcaaaaactcagaggtcattaatctgggcagatgcncctggatgctctattatttgggnggccttttattccttatatttcnatcttcaatgggttctttgaa

SEQ ID NO: 588 - DNA, 642 bp, Homo sapiens
  misc_feature (27)..(27): n is a, c, g, or t/u
  misc_feature (599)..(599): n is a, c, g, or t/u
aaaatgaatttgcccacaccttttggnccaattactgcgcgacctcccatgtatgaagactatatgccattgcatgcacctcttccacccacatctcctcagccacctgaggaacctcctttgccagacgaggatgaggaattatctagtgaagaatcagaatatgaaagcactgatgatgaggaccgacagagaatgaacaaattaatggaactagcaaatcttcagcccaaaagacctaaaacaataaagcagcgccatgtgagaaaaaagagaaaaataaaggatatgttgaatacacctttgtgtccttcacacagtttacatccagtgctgttaccttcagatgtatttgaccaaccacaacctgtaggtaacaaaagaattgaattccatatatctaccgacatgccagctgcatttaagaaagatttagaaaaggaacaaaattgtgaggaaaaaaatcatgatttacctgctactgaagttgatgcatccaatataggatttggaaaaatcttccccaaacctaatttggacatcacagaggagattaaagaagactctgatgaaatgccttcagaatgtatttctagaanggaattgggaaaaggcagaatttctagaaaaagaaatgggaac

SEQ ID NO: 589 - DNA, 650 bp, Homo sapiens
  misc_feature (20)..(20): n is a, c, g, or t/u
  misc_feature (22)..(22): n is a, c, g, or t/u
  misc_feature (27)..(27): n is a, c, g, or t/u
  misc_feature (44)..(44): n is a, c, g, or t/u
  misc_feature (53)..(53): n is a, c, g, or t/u
  misc_feature (70)..(70): n is a, c, g, or t/u
  misc_feature (80)..(80): n is a, c, g, or t/u
  misc_feature (82)..(82): n is a, c, g, or t/u
  misc_feature (85)..(85): n is a, c, g, or t/u
  misc_feature (101)..(101): n is a, c, g, or t/u
  misc_feature (103)..(103): n is a, c, g, or t/u
  misc_feature (122)..(122): n is a, c, g, or t/u
  misc_feature (133)..(133): n is a, c, g, or t/u
  misc_feature (150)..(150): n is a, c, g, or t/u
  misc_feature (156)..(156): n is a, c, g, or t/u
  misc_feature (166)..(166): n is a, c, g, or t/u
  misc_feature (172)..(172): n is a, c, g, or t/u
  misc_feature (181)..(181): n is a, c, g, or t/u
  misc_feature (183)..(183): n is a, c, g, or t/u
  misc_feature (201)..(201): n is a, c, g, or t/u
  misc_feature (204)..(204): n is a, c, g, or t/u
  misc_feature (217)..(217): n is a, c, g, or t/u
  misc_feature (222)..(222): n is a, c, g, or t/u
  misc_feature (245)..(245): n is a, c, g, or t/u
  misc_feature (251)..(251): n is a, c, g, or t/u
  misc_feature (255)..(255): n is a, c, g, or t/u
  misc_feature (258)..(258): n is a, c, g, or t/u
  misc_feature (276)..(276): n is a, c, g, or t/u
  misc_feature (297)..(297): n is a, c, g, or t/u
  misc_feature (301)..(301): n is a, c, g, or t/u
  misc_feature (309)..(309): n is a, c, g, or t/u
  misc_feature (322)..(322): n is a, c, g, or t/u
  misc_feature (331)..(331): n is a, c, g, or t/u
  misc_feature (365)..(365): n is a, c, g, or t/u
  misc_feature (376)..(376): n is a, c, g, or t/u
  misc_feature (386)..(386): n is a, c, g, or t/u
  misc_feature (389)..(389): n is a, c, g, or t/u
  misc_feature (398)..(398): n is a, c, g, or t/u
  misc_feature (412)..(412): n is a, c, g, or t/u
  misc_feature (416)..(416): n is a, c, g, or t/u
  misc_feature (421)..(421): n is a, c, g, or t/u
  misc_feature (432)..(432): n is a, c, g, or t/u
  misc_feature (439)..(439): n is a, c, g, or t/u
  misc_feature (441)..(441): n is a, c, g, or t/u
  misc_feature (452)..(452): n is a, c, g, or t/u
  misc_feature (454)..(454): n is a, c, g, or t/u
  misc_feature (462)..(462): n is a, c, g, or t/u
  misc_feature (469)..(469): n is a, c, g, or t/u
  misc_feature (476)..(476): n is a, c, g, or t/u
  misc_feature (497)..(497): n is a, c, g, or t/u
  misc_feature (518)..(518): n is a, c, g, or t/u
  misc_feature (524)..(524): n is a, c, g, or t/u
  misc_feature (534)..(534): n is a, c, g, or t/u
  misc_feature (548)..(548): n is a, c, g, or t/u
  misc_feature (562)..(562): n is a, c, g, or t/u
  misc_feature (568)..(568): n is a, c, g, or t/u
  misc_feature (590)..(590): n is a, c, g, or t/u
  misc_feature (598)..(598): n is a, c, g, or t/u
  misc_feature (613)..(613): n is a, c, g, or t/u
  misc_feature (625)..(625): n is a, c, g, or t/u
  misc_feature (644)..(644): n is a, c, g, or t/u
ggaaaggaaacaatttattntntttgnggaaaatcattaaaatncatgtaatntgtttccaattcactgntttaaaggcntntanatttaatttttaaatncnctttcaaagctgttacccncagttccatantccaggggggcaatttnttcctntcaaagttanaaagcncttgaaggncncgggattcaaaaaaaccnttnttaatttttaacnctttntttttccttccttaggatcttgntttggnctancanatcgagcaaactgaaccnccatgggttttccaaaaagcncatntccattancttcctttaaggnttttgctgntgctttttcattaggaagtccaatgaaagcttgncctttcatacnaccttttttnatnaaacgtttntcaaacatgatccnctgngtttntgatgaaaagncaacatntnttccaaaaatntntttaaggnccttttnttgaacntgtttagctaaattctttacntaaattctacagtttggttcncccggntcataacttntgaaaactgaaagngtttccatttcttntctaanaaattctgcccttttccaattnccttttanaaatacattctgaangcctttcatcanaaagcttctttaatctccnctggga

SEQ ID NO: 590 - DNA, 992 bp, Homo sapiens
  misc_feature (126)..(126): n is a, c, g, or t/u
  misc_feature (169)..(169): n is a, c, g, or t/u
  misc_feature (201)..(201): n is a, c, g, or t/u
  misc_feature (248)..(248): n is a, c, g, or t/u
  misc_feature (319)..(319): n is a, c, g, or t/u
  misc_feature (351)..(351): n is a, c, g, or t/u
  misc_feature (370)..(370): n is a, c, g, or t/u
  misc_feature (395)..(395): n is a, c, g, or t/u
  misc_feature (403)..(403): n is a, c, g, or t/u
  misc_feature (537)..(537): n is a, c, g, or t/u
  misc_feature (541)..(541): n is a, c, g, or t/u
  misc_feature (550)..(550): n is a, c, g, or t/u
  misc_feature (575)..(576): n is a, c, g, or t/u
  misc_feature (612)..(612): n is a, c, g, or t/u
  misc_feature (659)..(659): n is a, c, g, or t/u
  misc_feature (675)..(675): n is a, c, g, or t/u
  misc_feature (715)..(715): n is a, c, g, or t/u
  misc_feature (733)..(733): n is a, c, g, or t/u
  misc_feature (738)..(738): n is a, c, g, or t/u
  misc_feature (791)..(791): n is a, c, g, or t/u
  misc_feature (798)..(798): n is a, c, g, or t/u
  misc_feature (802)..(802): n is a, c, g, or t/u
  misc_feature (821)..(821): n is a, c, g, or t/u
  misc_feature (824)..(824): n is a, c, g, or t/u
  misc_feature (830)..(831): n is a, c, g, or t/u
  misc_feature (878)..(878): n is a, c, g, or t/u
  misc_feature (923)..(923): n is a, c, g, or t/u
  misc_feature (928)..(928): n is a, c, g, or t/u
  misc_feature (937)..(939): n is a, c, g, or t/u
  misc_feature (944)..(944): n is a, c, g, or t/u
  misc_feature (949)..(949): n is a, c, g, or t/u
  misc_feature (952)..(952): n is a, c, g, or t/u
  misc_feature (956)..(956): n is a, c, g, or t/u
  misc_feature (968)..(968): n is a, c, g, or t/u
aacaaaaggactatgaagaaagttcttgggattctgagagtctctgtgagactgtttcacagaaggatgtgtgtttacccaaggctacacatcaaaaagaaatagataaaataaatggaaaattanaagagtctcctgataatgatggttttctgaaggctccctgcanaatgaaagtttctattccaactaaagccttanaattgatggacatgcaaactttcaaagcagagcctcccgagaagccntctgccttcgagcctgccattgaaatgcaaaagtctgttccaaataaagccttggaattgaagaatgaacnaacattgagagcagatcagatgttcccttcanaatcaaaacaaaagaaggntgaagaaaattcttgggattctganagtctccntgagactgtttcacagaaggatgtgtgtgtacccaaggctacacatcaaaaagaaatggataaaataagtggaaaattagaagattcaactagcctatcaaaaatcttggatacagttcattcttgtgaaagancaanggaacttcnaaaagatcctgtgaacaaccgtacnngaaaaatggaacaaatgaaaaagaagttttggtgtnctgaaaaagaaactgtccgaagccaaagaagttaatcacggttggangaaccaaaaagtttantgggaaccaagagctctgcatgtgaggttttcacactctngaaaatgaaaattatctnttacntgaaaattgcttgttgaaaaaggaaattgcctgcttaaactgggaattgcccnctgaacncccnttcccgggaaagggaaatnatnctttgnnggccttaaaatttaaaaaaaaagaatggtggacttctgatgaccttnactgaagagggatctttacttaaagggcctttcaatttaggggcnccttnaagttttgnnnctggnaaacnaangccncttttaattggngggaaaccagacaagaaattcttt

SEQ ID NO: 591 - DNA, 738 bp, Homo sapiens
  misc_feature (487)..(487): n is a, c, g, or t/u
  misc_feature (623)..(623): n is a, c, g, or t/u
  misc_feature (654)..(654): n is a, c, g, or t/u
  misc_feature (699)..(699): n is a, c, g, or t/u
  misc_feature (714)..(714): n is a, c, g, or t/u
  misc_feature (718)..(718): n is a, c, g, or t/u
  misc_feature (730)..(730): n is a, c, g, or t/u
atctacttatttttattaacctttaaaaaatatatataaagcacacattgatttcaatgtttactgtttgttacaagtgttttgggtccttacttagaagttcagtgatgtttctgtgaccagaaatacatcataggaatgtcactcttatttatgtcagttagcctatggtaaaagtggttttattatacgtctttcacttaagctcagttccaagacctattgaccacgttaagtaaggacttactacatactaagcatgaaaggagacaggttactgtcagagacaggagttacaaatgcaattgaccctcgaatgacatagtgtgaactgcatgggtgctcttgttagcagatatttttcaagaaatataaaaaaatttggacgccgggcacggtagctcacgcctgtaatcccagaactttgggaggccgaggcgggcggatcacgaggtcaggagatccagaccatcctggctaacacggngaaaacccgtctctactaaaaatacaaaaaaaaaaataggtgggcgtggtggcaggcgcctgtagtcccactactcgggaggctgtggcaggagaatggcgtgaacctgggaggcagagtttgcagtgagccgaanattgcgccactgcactccacctgagtgacanaacgagatctgggtggattgaatgaagtctgctgctcatcagggnagatgggaatcctgngcantttttgcaattngggaacaa

SEQ ID NO: 592 - DNA, 681 bp, Homo sapiens
  misc_feature (400)..(400): n is a, c, g, or t/u
  misc_feature (488)..(488): n is a, c, g, or t/u
  misc_feature (502)..(502): n is a, c, g, or t/u
  misc_feature (535)..(535): n is a, c, g, or t/u
  misc_feature (544)..(544): n is a, c, g, or t/u
  misc_feature (558)..(558): n is a, c, g, or t/u
  misc_feature (604)..(604): n is a, c, g, or t/u
  misc_feature (610)..(610): n is a, c, g, or t/u
  misc_feature (637)..(637): n is a, c, g, or t/u
  misc_feature (660)..(660): n is a, c, g, or t/u
gttatgacgatgatgatgatgactgggactgggatgaaggagttggaaaactcgccaagggttatgtctggaatggaggaagcaacccacaggcaaatcgacagacctccgacagcagttcagccaaaatgtctactccagcagacaaggtcttacggaaatttgagaataaaattaatttagataagctaaatgttactgattccgtcataaataaagtcaccgaaaagtctagacaaaaggaagcagatatgtatcgcatcaaagataaggcagacagagcaactgtagaacaggtgttggatcccagaacaagaatgattttattcaagatgttgactagaggaatcataacagagataaatggctgcattagcacaggaaaagaagctaatgtatnccatgctagcacagcaaatggagagagcagagcaatcaaaatttataaaacttctattttggtgttcaaagatcgggataaatatgtnagtggagaattcanatttcgtcatggctattgtaaaggaaaccctangaaaatggngaaaacttgggccngaaaaagaaaatgaaggacttaatcaggcttaaccacaagcagaanataccnttgttccagaacccaataatgcttaanaaatcatgttccttggccatgangttttcattcggggaaaaaaa

SEQ ID NO: 593 - DNA, 723 bp, Homo sapiens
  misc_feature (131)..(131): n is a, c, g, or t/u
  misc_feature (143)..(143): n is a, c, g, or t/u
  misc_feature (152)..(152): n is a, c, g, or t/u
  misc_feature (176)..(176): n is a, c, g, or t/u
  misc_feature (270)..(270): n is a, c, g, or t/u
  misc_feature (618)..(618): n is a, c, g, or t/u
  misc_feature (652)..(652): n is a, c, g, or t/u
  misc_feature (658)..(658): n is a, c, g, or t/u
  misc_feature (662)..(662): n is a, c, g, or t/u
  misc_feature (671)..(671): n is a, c, g, or t/u
  misc_feature (693)..(693): n is a, c, g, or t/u
cacatgtttaggaattttgttttttcttttctctctctgggcttccttgaccatcttttttctttcttttttatcaatgtcagggtccgtggtgtgtttcttggggcgggcatggtctccctgctcttcanagtctgtgtcanagcactcanagcttccaatatcttctgaatcanaacaagtcctttcctccacttgattttctaggagtgcagggaccttctgaactcctgacaaatctttcttcaatcctgtaacagtctggtatanaatattatcttgttgggcattcatggccatgtcctcttccttcaatttcataattatgtccatatccctctcataatttttcacttcattcaaggttctaggaatatatgctcgcttaaacacctcttcatccacatgatcttggctagaccgttcttccttggtcctttgagatgctatttccatggcctttgagagataagcatccatgttctcatgtgtaatggatggatctgtgacaaattcaaagagctcccgcacagtcatgacagcaacactgtgcctcataaagaaatcattgacgttggcgcaatcctttctcaagaactccaaggcatgtggggtggnccggcctccacggactggagacacgtcaatgatntacacncctnccccggggnacagcatgttaaaatcactganaatctgcatgggccaagtctggcatcctga

SEQ ID NO: 594 - protein, 173 aa, Homo sapiens
  misc_feature (35)..(36): Xaa can be any naturally occurring amino acid
  misc_feature (47)..(47): Xaa can be any naturally occurring amino acid
  misc_feature (60)..(60): Xaa can be any naturally occurring amino acid
  misc_feature (71)..(71): Xaa can be any naturally occurring amino acid
  misc_feature (76)..(76): Xaa can be any naturally occurring amino acid
  misc_feature (122)..(122): Xaa can be any naturally occurring amino acid
  misc_feature (147)..(147): Xaa can be any naturally occurring amino acid
FRIEKDTAEEINNMKTKFKETIEKCDNLEHKLNDXXKEKQSVERKCXQLNTKVAKLTNEXKEEQEMNKCLXANQVXLQNKLKEEERVLKETCDQKDLQITEIQEQLRDVMFYLETQQKINHXPAETRQEIQEGQINIAMASASSPAXRGAVGSCPPGRAAARGASDLQSNRHP

SEQ ID NO: 595 - protein, 170 aa, Homo sapiens
  misc_feature (125)..(125): Xaa can be any naturally occurring amino acid
  misc_feature (129)..(130): Xaa can be any naturally occurring amino acid
  misc_feature (154)..(154): Xaa can be any naturally occurring amino acid
  misc_feature (163)..(163): Xaa can be any naturally occurring amino acid
SWRSFERRSVRRKPSGRSPACPSPWRRKKREARRKRRRPCMRRRWKGKRSPRRRENWGRTQTLTQASCLIETVRRRRIGFGKSCGRSGKPSRRRSRVRRSRSPSATGMALGTGRTVKMRKGNTMXQFCXXRSRSFGKTFSELRSPRVEHLCTLXEDFDHSLTXTVFTNSS

SEQ ID NO: 596 - protein, 237 aa, Homo sapiens
  misc_feature (223)..(223): Xaa can be any naturally occurring amino acid
  misc_feature (226)..(227): Xaa can be any naturally occurring amino acid
QYKGAASEAGRAMHLMKKREKQREQMEQMKQRIAEENIMKSNIDKKFSAHYDAVEAELKSSTVGLVTLNDMKAKQEALVKEREKQLAKKEQSKELQMKLEKLREKERKKEAKRKISSLSFTLEEEEEGGEEEEEAAMYEEEMEREEITTKKRKLGKNPDVDTSFLPDRDREEEENRLWEELRQEWEAKQEKIKSEEIEITFSYWDGSGHRPDSQDEKGQHHAXVLXXALEILRKDFQ

SEQ ID NO: 597 - protein, 255 aa, Homo sapiens
  misc_feature (5)..(5): Xaa can be any naturally occurring amino acid
  misc_feature (29)..(30): Xaa can be any naturally occurring amino acid
  misc_feature (33)..(33): Xaa can be any naturally occurring amino acid
SKSSXNVHKCSTLGDLSSLKVFPKDLERXXQNXCMVLPFLILTVRPVPRAIPVAEGDLDLLTLDLLLLGFPLLPQLFPKPILLLLTVSIRQEACVNVWVLPQFSLLRGDLFPFHLLLIHGRLLFLLASLFFLLQGEGQAGDLPLGFLLTLLLSKLLQLHLQLLGLLLLGQLLLPLLHQSLLLGLHVIQGHETHGAGLELCLHRVVVRRELLVNVGFHDVLLRDALLHLLHLLALLLPLLHQVHGAAGLARGALVL

SEQ ID NO: 598 - protein, 323 aa, Homo sapiens
  misc_feature (282)..(282): Xaa can be any naturally occurring amino acid
  misc_feature (291)..(291): Xaa can be any naturally occurring amino acid
  misc_feature (293)..(293): Xaa can be any naturally occurring amino acid
  misc_feature (296)..(296): Xaa can be any naturally occurring amino acid
  misc_feature (323)..(323): Xaa can be any naturally occurring amino acid
HLLKKRERQREQMEVLKQRIAEETILKSQVDKRFSAHYDAVEAELKSSTVGLVTLNDMKARQEALVRERERQLAKRQHLEEQRLQQERQREQEQRRERKRKISCLSFALDDLDDQADAAEARRAGNLGKNPDVDTSFLPDRDREEEENRLREELRQEWEAQREKVKDEEMEVTFSYWDGSGHRRTVRVRKGNTVQQFLKKRCRGCARTSWSCAPPAWSSSCSSRRTSSCRTTTPSTTSSSPGPGARAGRSSTSMCTMTCRLVKRRHHGERTNSHAGQRWVLXNLYQEEPSXFXPAXPLGRPIDPRRRKWGQSSPFRLQPGLAX

SEQ ID NO: 599 - protein, 319 aa, Homo sapiens
KLPTRRPGHGMAPKFPDSVEELRAAGNESFRNGQYAEASALYGRALRVLQAQGSSDPEEESVLYSNRAACHWKNGNCRDCIKDCTSALALVPFSIKPLLRRASAYEALEKYPMAYVDYKTVLQIDDNVTSAVEGINRMTRALMDSLGPEWRLKLPSFPLVPVSAQKRWNFLPSENHKEMAKSKSKETTATKNRVPSAGDVEKARVLKEEGNELVKKGNHKKAIEKYSESLLCSNLESATYSNRALCYLVLKQYTEAVKDCTEALKLDGKNVKAFYRRAQAHKALKDYKSSFADISNLLQIEPRNGPAQKLRQEVKQNLH

SEQ ID NO: 600 - protein, 195 aa, Homo sapiens
  misc_feature (170)..(170): Xaa can be any naturally occurring amino acid
  misc_feature (191)..(191): Xaa can be any naturally occurring amino acid
  misc_feature (194)..(194): Xaa can be any naturally occurring amino acid
LTIKMSTADALDDENTFKILVATDIHLGFMEKDAVRGNDTFVTLDEILRLAQENEVDFILLGGDLFHENKPSRKTLHTCLELLRKYCMGDRPVQFEILSDQSVNFGFSKFPWVNYQDGNLNISIPVFSIHGNHDDPTGADALCALDILSCAGFVNHFGTVQWLWEKIDIXSGFCFKKGSPKGMALLLGLRXPFXE

SEQ ID NO: 601 - protein, 175 aa, Homo sapiens
EDGADEAEAEIIQLLKRAKLSIMKDEPEEAELILHDALRLAYQTDNKKAITYTYDLMANLAFIRGQLENAEQLFKATMSYLLGGGMKQEDNAIIEISLKLASIYAAQNRQEFAVAGYEFCISTLEEKIEREKELAEDIMSVEEKANTHLLLGMCLDACARYLLFSKQPVTGTKDV

SEQ ID NO: 602 - protein, 937 aa, Homo sapiens
APAARAEGRELRRERTGWWASERRGMVDYHAANQSYQYGPSSAAMAWRRGSMGDYMAQEDDWDRDLLLDPAWEKQQRKTFTAWSNSHLRKAGTQIENIDEDFRDGLKLMLLLEVISGERLPKPERGKMRVHKINNVNKALDFIASKGIKLDFHRAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETETAANRICKVLAVNQENCSTSMEDYEKLASDLLEWIRRTIPWLEDRVPQKTIQEMQQKLEDFRDYRRVHKPPKVQEKCQLEINFNSVQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAASAQELNELDYYDSHNVNTRCQKICDQWDALGSLTHSRREALEKTEKQLEAIIDQLHLEYAKPAAPFNNWMESAMEDLQDMFIVHTIEEIEGLISAHDQFKSTLPDADREREAILHPQGGQRIAESNHIKLSGSNPYTTVTPQIINSKWEKVQQLVPKRDHALLEEQSKQQQSNEHLRRQFASQANVVGPWIQTKMEEIAISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKDHGGALGRGVQGLPHQPGLRRGERPAGEAEFNRIMSLVDPNHSGLVTFQAFIDFMSRETTDTDTADQVITSFKVLAGDKNFITAEELRRELPPDQAEYCIARMAPYQGPDGVRGALDYKSFSTALYGESDL

SEQ ID NO: 603 - protein, 1884 aa, Homo sapiens
VAGCRRRGAGDPNMANLEESFPRGGTRKIHKPEKAFQQSVEQDNLFDISTEEGSTKRKKSQKGPAKTKKLKIEKRESSKSAREKFEILSVESLCEGMRILGCVKEVNELELVISLPNGLQGFVQVTEICDAYTKKLNEQVTQEQPLKDLLHLPELFSPGMLVRCVVSSLGITDRGKKSVKLSLNPKNVNRVLSAEALKPGMLLTGTVSSLEDHGYLVDIGVDGTRAFLPLLKAQEYIRQKNKGAKLKVGQYLNCIVEKVKGNGGVVSLSVGHSEVSTAIATEQQSWNLNNLLPGLVVKAQVQKVTPFGLTLNFLTFFTGVVDFMHLDPKKAGTYFSNQAVRACILCVHPRTRVVHLSLRPIFLQPGRPLTRLSCQNLGAVLDDVPVQGFFKKAGATFRLKDGVLAYARLSHLSDSKNVFNPEAFKPGNTHKCRIIDYSQMDELALLSLRTSIIEAQYLRYHDIEPGAVVKGTVLTIKSYGMLVKVGEQMRGLVPPMHLADILMKNPEKKYHIGDEVKCRVLLCDPEAKKLMMTLKKTLIESKLPVITCYADAKPGLQTHGFIIRVKDYGCIVKFYNNVQGLVPKHELSTEYIPDPERVFYTGQVVKVVVLNCEPSKERMLLSFKLSSDPEPKKEPAGHSQKKGKAINIGQLVDVKVLEKTKDGLEVAVLPHNIRAFLPTSHLSDHVANGPLLHHWLQAGDILHRVLCLSQSEGRVLLCRKPALVSTVEGGQDPKNFSEIHPGMLLIGFVKSIKDYGVFIQFPSGLSGLAPKAIMSDKFVTSTSDHFVEGQTVAAKVTNVDEEKQRMLLSLRLSDCGLGDLAITSLLLLNQCLEELQGVRSLMSNRDSVLIQTLAEMTPGMFLDLVVQEVLEDGSVVFSGGPVPDLVLKASRYHRAGQEVESGQKKKVVILNVDLLKLEVHVSLHQDLVNRKARKLRKGSEHQAIVQHLEKSFAIASLVETGHLAAFSLTSHLNDTFRFDSEKLQVGQGVSLTLKTTEPGVTGLLLAVEGPAAKRTMRPTQKDSETVDEDEEVDPALTVGTIKKHTLSIGDMVTGTVKSIKPTHVVVTLEDGIIGCIHASHILDDVPEGTSPTTKLKVGKTVTARVIGGRDMKTFKYLPISHPRFVRTIPELSVRPSELEDGHTALNTHSVSPMEKIKQYQAGQTVTCFLKKYNVVKKWLEVEIAPDIRGRIPLLLTSLSFKVLKHPDKKFRVGQALRATVVGPDSSKTFLCLSLTGPHKLEEGEVAMGRVVKVTPNEGLTVSFPFGKIGTVSIFHMSDSYSETPLEDFVPQKVVRCYILSTADNVLTLSLRSSRTNPETKSKVEDPEINSIQDIKEGQLLRGYVGSIQPHGVFFRLGPSVVGLARYSHVSQHSPSKKALYNKHLPEGKLLTARVLRLNHQKNLVELSFLPGDTGKPDVLSASLEGQLTKQEERKTEAEERDQKGEKKNQKRNEKKNQKGQEEVEMPSKEKQQPQKPQAQKRGGRECRESGSEQERVSKKPKKAGLSEEDDSLVDVYYREGKEEAEETNVLPKEKQTKPAEAPRLQLSSGFAWNVGLDSLTPALPPLAESSDSEEDEKPHQATIKKSKKERELEKQKAEKELSRIEEALMDPGRQPESADDFDRLVLSSPNSSILWLQYMAFHLQATEIEKARAVAERALKTISFREEQEKLNVWVALLNLENMYGSQESLTKVFERAVQYNEPLKVFLHLADIYAKSEKFQEAGELYNRMLKRFRQEKAVWIKYGAFLLRRSQAAASHRVLQRALECLPSKEHVDVIAKFAQLEFQLGDAERAKAIFENTLSTYPKRTDVWSVYIDMTIKHGSQKDVRDIFERVIHLSLAPKRMKFFFKRYLDYEKQHGTEKDVQAVKAKALEYVEAKSSVLED

SEQ ID NO: 604 - protein, 192 aa, Homo sapiens
  misc_feature (92)..(92): Xaa can be any naturally occurring amino acid
  misc_feature (133)..(133): Xaa can be any naturally occurring amino acid
  misc_feature (150)..(150): Xaa can be any naturally occurring amino acid
  misc_feature (157)..(157): Xaa can be any naturally occurring amino acid
DALLREFQEEIARLKAQLEKRSIEEKMRLLKEKEKKMEDLRREKDAAEMLGAKIKAMESKLLVGGKNIVDHTNEQQKILEQKRQEIAEQKRXEREIQQQMESRDEETLELKETYSSLQQEVDIKTKKLKKLFXKLQAVKAEIHDLQEEHXKERQELXQTQNELTRELKLKHLIIENFIPLEEKSKIMNRAFF

SEQ ID NO: 605 - protein, 186 aa, Homo sapiens
KPGREKQEGTMASSSGNDDDLTIPRAAINKMIKETLPNVRVANDARELVVNCCTEFIHLISSEANEICNKSEKKTISPEHVIQALESLGFGSYISEVKEVLQECKTVALKRRKASSRLENLGIPEEELLRQQQELFAKARQQQAELAQQEWLQMQQAAQQAQLAAASASASNQAGSSQDEEDDDDI

SEQ ID NO: 606 - protein, 328 aa, Homo sapiens
EPVVLRFMIFCRLLAKMANNDAVLKRLEQKGAEADQIIEYLKQQVSLLKEKAILQATLREEKKLRVENAKLKKEIEELKQELIQAEIQNGVKQIAFPSGTPLHANSMVSENVIQSTAVTTVSSGTKEQIKGGTGDEKKAKEKIEKKGEKKEKKQQSIAGSADSKPIDVSRLDLRIGCIITARKHPDADSLYVEEVDVGEIAPRTVVSGLVNHVPLEQMQNRMVILLCNLKPAKMRGVLSQAMVMCASSPEKIEILAPPNGSVPGDRITFDAFPGEPDKELNPKKKIWEQIQPDLHTNDECVATYKGVPFEVKGKGVCRAQTMSNSGIK

SEQ ID NO: 607 - protein, 347 aa, Homo sapiens
APVREAARARGRRAGWGSAAQCQRQRQTRAPRSPARRLPWDSRARTPALPVRCPSMELLCCEGTRHAPRAGPDPRLLGDQRVLQSLLRLEERYVPRASYFQCVQREIKPHMRKMLAYWMLEVCEEQRCEEEVFPLAMNYLDRYLSCVPTRKAQLQLLGAVCMLLASKLRETTPLTIEKLCIYTDHAVSPRQLRDWEVLVLGKLKWDLAAVIAHDFLAFILHRLSLPRDRQALVKKHAQTFLALCATDYTFAMYPPSMIATGSIGAAVQGLGACSMSGDELTELLAGITGTEVDCLRACQEQIEAALRESLREASQTSSSPAPKAPRGSSSQGPSQTSTPTDVTAIHL

SEQ ID NO: 608 - protein, 526 aa, Homo sapiens
SGAAAKMPLELTQSRVQKIWVPVDHRPSLPRSCGPKLTNSPTVIVMVGLPARGKTYISKKLTRYLNWIGVPTKVFNVGEYRREAVKQYSSYNFFRPDNEEAMKVRKQCALAALRDVKSYLAKEGGQIAVFDATNTTRERRHMILHFAKENDFKAFFIESVCDDPTVVASNIMEVKISSPDYKDCNSAEAMDDFMKRISCYEASYQPLDPDKCDRDLSLIKVIDVGRRFLVNRVQDHIQSRIVYYLMNIHVQPRTIYLCRHGENEHNLQGRIGGDSGLSSRGKKFASALSKFVEEQNLKDLRVWTSQLKSTIQTAEALRLPYEQWKALNEIDAGVCEELTYEEIRDTYPEEYALREQDKYYYRYPTGESYQDLVQRLEPVIMELERQENVLVICHQAVLRCLLAYFLDKSAEEMPYLKCPLHTVLKLTPVAYGCRVESIYLNVESVCTHRERSEDAKKGPNPLMRRNSVTPLASPEPTKKPRINSFEEHVASTSAALPSCLPPEVPTQLPGQNMKGSRSSADSSRKH

SEQ ID NO: 609 - protein, 205 aa, Homo sapiens
  misc_feature (52)..(52): Xaa can be any naturally occurring amino acid
  misc_feature (76)..(76): Xaa can be any naturally occurring amino acid
  misc_feature (106)..(106): Xaa can be any naturally occurring amino acid
  misc_feature (128)..(128): Xaa can be any naturally occurring amino acid
  misc_feature (132)..(132): Xaa can be any naturally occurring amino acid
  misc_feature (175)..(175): Xaa can be any naturally occurring amino acid
  misc_feature (197)..(197): Xaa can be any naturally occurring amino acid
  misc_feature (203)..(203): Xaa can be any naturally occurring amino acid
NISCNLLNIVLKVKNRMVVWELEALFPLLQNAYLSCIIVKWKCHKLPIIHWXPLYFTQLTLTWEIPHNHSIREASXSPQQLRLIGLFQPGIIRSRLPQSQKGEEAXPVWAPGCLVQPRVHSWMPRSPXWVSXECSALQGAGLVAQGPFQEFHSLTLVQAAAWAPPGAGSWAGRPXWRPMLLKAVDARLFWWVRGLAXRGDTIXVS

SEQ ID NO: 610 - protein, 199 aa, Homo sapiens
VIPSTGIKLPSSVFASEFEEDVGLLNKAAPVSGPRLDFDPDIVAALDDDFDFDDPDNLLEDDFILQANKATGEEEGMDIQKSENEDDSEWEDVDDEKGDSNDDYDSAGLLSDEDCMSVPGKTHRAIADHLFWSEETKSRFTEYSMTSSVMRRNEQLTLHDERFEKFYEQYDDDEIGALDNAELEGSIQVGQQSLTGSFE

SEQ ID NO: 611 - protein, 117 aa, Homo sapiens
SCSGAGTPRTGTRSPMEAWHAGRGNRPTPPSALSPARKRGKNCNSSGKLSSKSLPTSDDYELGAGIRKRHKGPKEEHNALIGTGKARERNQTWDEHEASSKFISQLKIKKKKMDSDQ

SEQ ID NO: 612 - protein, 128 aa, Homo sapiens
SLLAAGSHMLREVLDGPVVGPAQEPAAPTGAEAHNKYSWMRKKEERMYPMKSSVEDMDVLELDFRMWRAEVQHQYKEKQHELVKLQRRRDSEDRHEESHGSLARRPWKQTHAPERPVARPQEGEELQQ

SEQ ID NO: 613 - protein, 197 aa, Homo sapiens
ARALEKLEAAESLVLEQSFLHGITLLSEIAELELERRSQEMGGAERALVARPSLESLLAAGSHMLREVLDGPVVDPLKNLRLPRELKPNKKYSWMRKKEERMYAMKSSLEDMDALELDFRMRLAEVQRQYKEKQRELVKLQRRRDSEDRREEPHRSLARRGPGRPRKRTHAPSALSPPRKRGKSGHSSGKLSSKVSC

SEQ ID NO: 614 - protein, 184 aa, Homo sapiens
  misc_feature (36)..(36): Xaa can be any naturally occurring amino acid
  misc_feature (40)..(40): Xaa can be any naturally occurring amino acid
  misc_feature (59)..(59): Xaa can be any naturally occurring amino acid
  misc_feature (82)..(82): Xaa can be any naturally occurring amino acid
  misc_feature (86)..(86): Xaa can be any naturally occurring amino acid
  misc_feature (109)..(109): Xaa can be any naturally occurring amino acid
  misc_feature (134)..(134): Xaa can be any naturally occurring amino acid
  misc_feature (144)..(144): Xaa can be any naturally occurring amino acid
  misc_feature (182)..(182): Xaa can be any naturally occurring amino acid
LKMNSICLIKLGITKIAVQTSSHTPTRQNSIYKMFXGKPXPNPCPKRARTKPGVSGWAXNVSAGVGGTRGRGRRAGRRASGXKRRXKSSHITAQKEPAGDIITMIQSNXSKNQNHSADNSKLRCQEPIWQPSCXHSHGPFTHHXSRAPTRFPFAYLHAFFARKHGRFFGFGASNLGKPFPPXSC

SEQ ID NO: 615 - protein, 188 aa, Homo sapiens
ARAEVQEKKKKMKNENADKLLKSEKQMKKSEKKSKQEKEKSKKKKGGKTEQDGYQKPTNKHFTQSPKKSVADLLGSFEGKRRLLLITAPKAENNMYVQQRDEYLESFCKMATRKISVITIFGPVNNSTMKIDHFQLDNEKPMRVVDDEDLVDQRLISELRKEYGMTYNDFFMVLTDVDLRVKQYYEVQ

SEQ ID NO: 616 - protein, 129 aa, Homo sapiens
  misc_feature (103)..(103): Xaa can be any naturally occurring amino acid
ARGGGGARLRRGDASPVRPRRGLHAPLARSLPPPAPRPAMAEPSSARRPVPLIESELYFLIARYLSAGPCRRAAQVLVQELEQYQLLPKRLDWEGNEHNRSYXELVLSNKHVAPDHLLQICERIGSYVG

SEQ ID NO: 617 - protein, 215 aa, Homo sapiens
  misc_feature (121)..(121): Xaa can be any naturally occurring amino acid
  misc_feature (129)..(129): Xaa can be any naturally occurring amino acid
  misc_feature (132)..(132): Xaa can be any naturally occurring amino acid
  misc_feature (154)..(154): Xaa can be any naturally occurring amino acid
  misc_feature (157)..(157): Xaa can be any naturally occurring amino acid
  misc_feature (161)..(161): Xaa can be any naturally occurring amino acid
  misc_feature (165)..(166): Xaa can be any naturally occurring amino acid
  misc_feature (169)..(169): Xaa can be any naturally occurring amino acid
  misc_feature (175)..(175): Xaa can be any naturally occurring amino acid
  misc_feature (177)..(177): Xaa can be any naturally occurring amino acid
  misc_feature (190)..(190): Xaa can be any naturally occurring amino acid
  misc_feature (197)..(197): Xaa can be any naturally occurring amino acid
  misc_feature (213)..(213): Xaa can be any naturally occurring amino acid
RRGRPGPGGAALHAGHVGVGPLRPPALHGPQAGPPGAGALPAPGPQIRRSGAEPRGQAVRVPRRQTAGGAVWGRRHRLLLGQAGRDTVWEDAREPLAPVALPGGRNPVNYGRPYRLSCVEXFAATFLHXRLXQTLLSFCCGKFKWGKGLLGPEXAKXLDKXPVLXXPRXKCFKAXQXFLGKLPMEKPPRXEENRIPXNVGFKGKKILENPKRXFW

SEQ ID NO: 618 - protein, 137 aa, Homo sapiens
PRHLPTRSLEAFAEEVGAALQASVEPGAADGEGGPGPAALPCTLAMWELGHCDPRRCTGRKLARLGLVRCLRLGHRFGGLVLSPVGKQYASPADRQLVAQSGVAVIDCSWARLDETPFGKMRGSHLRLLPYLVAATP

SEQ ID NO: 619 - protein, 227 aa, Homo sapiens
  misc_feature (218)..(218): Xaa can be any naturally occurring amino acid
GTSIYSGRLLSRANTEKSYGIDENGRDENTMKNIFSKKRKLEVACSDCEVEVLPLGLETHPRTAKTEKCPPKFSNNPKELTMETKYDNISRIQYHSVIRDPESKTAIFQHNGKKMEFVSSESVTPEDNDGFKPPREHLNSKTKGAQKDSSSNHVDEFEDNLLIESDVIDITKYREETPPRSRCNQATTLDNQNIKKAIEVQIQKPPRGTIYSMSKTSXYFVMKKLLK

SEQ ID NO: 620 - protein, 227 aa, Homo sapiens
  misc_feature (3)..(3): Xaa can be any naturally occurring amino acid
IPXQPFFKPNGKKMEFVSSESVTPEDNDGFKPPREHLNSKTKGAQKDSSSNHVDEFEDNLLIESDVIDITKYREETPPRSRCNQATTLDNQNIKKAIEVQIQKPQEGRSTACQRQQVFCDEELLSETKNTSSDSLTKFNKGNVFLLDATKEGNVGRFLNHSCCPNLLVQNVFVETHNRNFPLVAFFTNRYVKARTELTWDYGYEAGTVPEKEIFCQCGVNKCRKKIL

SEQ ID NO: 621 - protein, 204 aa, Homo sapiens
LNTLSTPEEKLAALCKKYADLLEESRSVQKQMKILQKKQAQIVKEKVHLQSEHSKAILARSKLESLCRELQRHNKTLKEENMQQAREEEERRKEATAHFQITLNEIQAQLEQHDIHNAKLRQENIELGEKLKKLIEQYALREEHIDKVFKHKELQQQLVDAKLQQTTQLIKEADEKHQREREFLLKEATESRHKYEQMKQQEVH

SEQ ID NO: 622 - protein, 187 aa, Homo sapiens
ELGPETRGRAVGPRNEAKMLEGDLVSKMLRAVLQSHKNGVALPRLQGEYRSLTGDWIPFKQLGFPTLEAYLRSVPAVVRIETSRSGEITCYAMACTETARIAQLVARQRSSKRKTGRQVNCQMRVKKTMPFFLEGKPKATLRQPGFASNFSVGKKPNPAPLRDKGNSAGVKPDAEMSPYMLHTTLWK

SEQ ID NO: 623 - protein, 141 aa, Homo sapiens
QWRKTKCMLQKWKISGTGCFLKGILTNGLVSVYELDYGKHELVNIRKVQPLVDMFRKLPFQAVTAQLAGVKCNQWSEEASMVFRNHVEKKPLVALVQTVIENANPWDRKVVVYLVDTSLPDTDTWIHDFMSEYLIELSKVN

SEQ ID NO: 624 - protein, 201 aa, Homo sapiens
  misc_feature (196)..(196): Xaa can be any naturally occurring amino acid
MVSGNVRVMSEMLTELVPTQAEPADLELLQELNRTCRAMQQRVLELIPQIANEQLTEELLIVNDNLNNVFLRHERFERFRTGQTTKAPSEAEPAADLIDMGPDPAATGNLSSQLAGMNLGSSSVRAGLQSLEASGRLEDEFDMFALTRGSSLADQRKEVKYEAPQATDGLAGALDARQQSTGRDPSHPGLPHGGHXAVAVH

SEQ ID NO: 625 - protein, 244 aa, Homo sapiens
EARSAAQVALCIQQLQKSIAWEKSIMKVYCQICRKGDNEELLLLCDGCDKGCHTYCHRPKITTIPDGDWFCPACIAKASGQTLKIKKLHVKGKKTNESKKGKKVTLTGDTEDEDSASTSSSLKRGNKDLKKRKMEENTSINLSKQESFTSVKKPKRDDSKDLALCSMILTEMETHEDAWPFLLPVNLKLVPGYKKVIKKPMDFSTIREKLSSGQYPNLETFALDVRLVFDTVKHLMEDDSDIGR

SEQ ID NO: 626 - protein, 208 aa, Homo sapiens
  misc_feature (190)..(190): Xaa can be any naturally occurring amino acid
  misc_feature (199)..(199): Xaa can be any naturally occurring amino acid
  misc_feature (202)..(202): Xaa can be any naturally occurring amino acid
ARGKPSLVRETSRITVLEALRHPIQVSRRLLSRPQDALEGVVLSPSLEARVRDIAIATRNTKKNRSLYRNILMYGPPGTGKTLFAKKLALHSGMDYAIMTGGDVAPMGREGVTAMHKLFDWANTSRRGLLLFVDEADAFLRKRATEKISEDLRATLNAFLYRTGQHSNKFMLVLASNQPEQFDWAINDRXNEMVHFDLXRAXRNGSAW

SEQ ID NO: 627 - protein, 230 aa, Homo sapiens
  misc_feature (20)..(20): Xaa can be any naturally occurring amino acid
  misc_feature (31)..(31): Xaa can be any naturally occurring amino acid
  misc_feature (39)..(39): Xaa can be any naturally occurring amino acid
  misc_feature (87)..(88): Xaa can be any naturally occurring amino acid
  misc_feature (93)..(93): Xaa can be any naturally occurring amino acid
  misc_feature (95)..(95): Xaa can be any naturally occurring amino acid
  misc_feature (112)..(112): Xaa can be any naturally occurring amino acid
  misc_feature (119)..(119): Xaa can be any naturally occurring amino acid
  misc_feature (134)..(134): Xaa can be any naturally occurring amino acid
  misc_feature (169)..(169): Xaa can be any naturally occurring amino acid
  misc_feature (182)..(182): Xaa can be any naturally occurring amino acid
  misc_feature (185)..(185): Xaa can be any naturally occurring amino acid
  misc_feature (196)..(196): Xaa can be any naturally occurring amino acid
  misc_feature (199)..(200): Xaa can be any naturally occurring amino acid
  misc_feature (205)..(205): Xaa can be any naturally occurring amino acid
  misc_feature (213)..(213): Xaa can be any naturally occurring amino acid
  misc_feature (219)..(219): Xaa can be any naturally occurring amino acid
  misc_feature (222)..(222): Xaa can be any naturally occurring amino acid
VNRPQLQPQAWTGQLTVRPXTPPPGSLLPPXSGSPVCEXSGHAGHRGKQGSGCPTWVWPWQAPPHLALLWEPRTKTSPAWLLLPRGXXQHPPXQXPGQGLGCKASPSPCEPXGKCISQXCLEGQEGGLPLPSQXLQQGVPWGAKRPTATTRHPGGQRPWAQPNPHPGAXPKCAGAGKAGVGXGPXPGFRELWISLXTSXXGGLRXHAQALSLXPAQSSXGAXGQYFSPGC

SEQ ID NO: 628 - protein, 215 aa, Homo sapiens
  misc_feature (5)..(5): Xaa can be any naturally occurring amino acid
  misc_feature (15)..(16): Xaa can be any naturally occurring amino acid
  misc_feature (24)..(24): Xaa can be any naturally occurring amino acid
  misc_feature (72)..(73): Xaa can be any naturally occurring amino acid
  misc_feature (78)..(79): Xaa can be any naturally occurring amino acid
  misc_feature (96)..(96): Xaa can be any naturally occurring amino acid
  misc_feature (103)..(103): Xaa can be any naturally occurring amino acid
  misc_feature (118)..(118): Xaa can be any naturally occurring amino acid
  misc_feature (153)..(153): Xaa can be any naturally occurring amino acid
  misc_feature (166)..(166): Xaa can be any naturally occurring amino acid
  misc_feature (170)..(170): Xaa can be any naturally occurring amino acid
  misc_feature (180)..(180): Xaa can be any naturally occurring amino acid
  misc_feature (183)..(183): Xaa can be any naturally occurring amino acid
  misc_feature (185)..(185): Xaa can be any naturally occurring amino acid
  misc_feature (189)..(189): Xaa can be any naturally occurring amino acid
  misc_feature (197)..(198): Xaa can be any naturally occurring amino acid
  misc_feature (204)..(204): Xaa can be any naturally occurring amino acid
  misc_feature (207)..(207): Xaa can be any naturally occurring amino acid
QCGLXHPRQVPSSLXXQGHQCVKXRGMPATGGSRVQAAPPGSGPGRRPLTWLCCGSREQRHHLPGSCCPGGXXSTHPXXGLGRGWGAKPHPPPVSXTENAFPXSVSRGRKEACPSLAXAYNRGCPGGQNDRPPPQDILGDKGPGHSPIPIQEXILNVQGPARQGWXGVRXQASVSCGSPXGLXDXEGFXPTPRPFRXXQHNLLXVLXDSIFHPGV

SEQ ID NO: 629 - protein, 236 aa, Homo sapiens
  misc_feature (222)..(222): Xaa can be any naturally occurring amino acid
  misc_feature (233)..(233): Xaa can be any naturally occurring amino acid
ARAEVEKQTSLTPRELEIRRREDEYRFTKLLQIAGISPHGNALGASMQQQVNQQIPQEKRGGEVLDSSHDDIKLEKSNILLLGPTGSGKTLLAQTLAKCLDVPFAICDCTTLTQAGYVGEDIESVIAKLLQDANYNVEKAQQGIVFLDEVDKIGSVPGIHQLRDVGGEGVQQGLLKLLEGTIVNVPEKNSRKLRGETVQVDTTNILFVASGAFNGFRQNHQXGGKNEKYLGFXTPI

SEQ ID NO: 630 - protein, 285 aa, Homo sapiens
  misc_feature (183)..(183): Xaa can be any naturally occurring amino acid
  misc_feature (263)..(263): Xaa can be any naturally occurring amino acid
  misc_feature (266)..(266): Xaa can be any naturally occurring amino acid
  misc_feature (274)..(274): Xaa can be any naturally occurring amino acid
  misc_feature (279)..(279): Xaa can be any naturally occurring amino acid
SRACRSTLVDPKENMDTSNTSISKMKRSRPTSEGSDIESTEPQKQCSKKKKKRDRVEASSLPEVRTGKRKRSSSEDAESLAPRSKVKKIIQKDIIKEASEASKENRDIEISTEEEKDTGDLKDSSLLKTKRKHKKKHKERHKMGEEVIPLRVLSKSEWMDLKKEYLALQKASMASLKKTISQXKSESEMETDSGVPQNTGMKNEKTANREECRTQEKVNATGPQFVSGVIVKIISTEPLLAGNKSGIFGSNLRKFFYVDLLEXEPXWPARLKTXEDAQXVINAFP

SEQ ID NO: 631 - protein, 593 aa, Homo sapiens
LDMAPEINLPGPMSLIDNTKGQLVVNPEALKILSAITQPVVVVAIVGLYRTGKSYLMNKLAGKKNGFSLGSTVKSHTKGIWMWCVPHPKKPEHTLVLLDTEGLGDIEKGDNENDSWIFALAILLSSTFVYNSMGTINQQAMDQLHYVTELTDRIKANSSPGNNSVDDSADFVSFFPAFVWTLRDFTLELEVDGEPITADDYLELSLKLRKGTDKKSKSFNDPRLCIRKFFPKRKCFVFDWPAPKKYLAHLEQLKEEELNPDFIEQVAEFCSYILSHSNVKTLSGGIAVNGPRLESLVLTYVNAISSGDLPCMENAVLALAQIENSAAVEKAIAHYEQQMGQKVQLPTETLQELLDLHRDSEREAIEVFMKNSFKDVDQMFQRKLGAQLEARRDDFCKQNSKASSDCCMALLQDIFGPLEEDVKQGTFSKPGGYRLFTQKLQELKNKYYQVPRKGIQAKEVLKKYLESKEDVADALLQTDQSLSEKEKAIEVERIKAESAEAAKKMLEEIQKKNEEMMEQKEKSYQEHVKQLTEKMERDRAQLMAEQEKTLALKLQEQERLLKEGFENESKRLQKDIWDIQMRSKSLEPICNIL

SEQ ID NO: 632 - protein, 191 aa, Homo sapiens
  misc_feature (10)..(10): Xaa can be any naturally occurring amino acid
  misc_feature (12)..(12): Xaa can be any naturally occurring amino acid
  misc_feature (24)..(24): Xaa can be any naturally occurring amino acid
  misc_feature (80)..(80): Xaa can be any naturally occurring amino acid
  misc_feature (102)..(102): Xaa can be any naturally occurring amino acid
  misc_feature (125)..(125): Xaa can be any naturally occurring amino acid
RRPAAGLRDXVXSAPRGMASEGPXEPESEGIKLSGICQTICPQICRAQCGMVRVLRSMCLPQLCSHILSVCSGTTSDRNXYSVPGSQYLYNQPSCYRGFQTXKHRNENTCPLPQEMKALFKKKTXDEKKTYDQQKFDSERADGTISSEIKSARGSHHLSIYAENSLKSDGYHKRTDRKSRIICKKWIYLQT

SEQ ID NO: 633 - protein, 149 aa, Homo sapiens
  misc_feature (12)..(12): Xaa can be any naturally occurring amino acid
  misc_feature (20)..(20): Xaa can be any naturally occurring amino acid
  misc_feature (26)..(26): Xaa can be any naturally occurring amino acid
  misc_feature (28)..(28): Xaa can be any naturally occurring amino acid
  misc_feature (31)..(31): Xaa can be any naturally occurring amino acid
  misc_feature (35)..(35): Xaa can be any naturally occurring amino acid
  misc_feature (44)..(44): Xaa can be any naturally occurring amino acid
  misc_feature (51)..(53): Xaa can be any naturally occurring amino acid
  misc_feature (59)..(60): Xaa can be any naturally occurring amino acid
  misc_feature (72)..(72): Xaa can be any naturally occurring amino acid
  misc_feature (84)..(84): Xaa can be any naturally occurring amino acid
  misc_feature (86)..(86): Xaa can be any naturally occurring amino acid
  misc_feature (90)..(90): Xaa can be any naturally occurring amino acid
  misc_feature (99)..(99): Xaa can be any naturally occurring amino acid
  misc_feature (103)..(103): Xaa can be any naturally occurring amino acid
  misc_feature (109)..(109): Xaa can be any naturally occurring amino acid
  misc_feature (115)..(115): Xaa can be any naturally occurring amino acid
  misc_feature (120)..(120): Xaa can be any naturally occurring amino acid
  misc_feature (122)..(122): Xaa can be any naturally occurring amino acid
  misc_feature (124)..(126): Xaa can be any naturally occurring amino acid
  misc_feature (129)..(129): Xaa can be any naturally occurring amino acid
  misc_feature (141)..(141): Xaa can be any naturally occurring amino acid
  misc_feature (149)..(149): Xaa can be any naturally occurring amino acid
LQVCLPAGGPCXVCPQKVMXLLPIFXLXKMXPPVXRAVVTSPWXGFTSLLXXXNFQTNXXLGNPPGGLEKPXQVAVPPPPLPFXAXGEPXPSIFWAPFXWGNXVGGLFXSPLKKXGFLEXPXIXXXPLXFLDGPPKFFFQXFFGPFFKX

SEQ ID NO: 634 - protein, 124 aa, Homo sapiens
VNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYKSK

SEQ ID NO: 635 - protein, 187 aa, Homo sapiens
  misc_feature (12)..(18): Xaa can be any naturally occurring amino acid
  misc_feature (20)..(20): Xaa can be any naturally occurring amino acid
  misc_feature (97)..(97): Xaa can be any naturally occurring amino acid
  misc_feature (113)..(113): Xaa can be any naturally occurring amino acid
  misc_feature (169)..(169): Xaa can be any naturally occurring amino acid
  misc_feature (176)..(176): Xaa can be any naturally occurring amino acid
  misc_feature (181)..(182): Xaa can be any naturally occurring amino acid
  misc_feature (187)..(187): Xaa can be any naturally occurring amino acid
RTKAKKDKAQRXXXXXXXGXAPHSESDLPEQEEEILGSDDDEQEDPNDYCKGGYHLVKIGDLFNGRYHVIRKLGWGHFSTVWLSWDIQGKKFVAMKXVKSAEHYTETALDEIXLLKSVRNSDPNDPNREMVVQLLDDFKISGVNGTHICMVFEVLGHHLLKWIIKSNYXGLPLPCXKKIIXXVFTGX

SEQ ID NO: 636 - protein, 275 aa, Homo sapiens
  misc_feature (198)..(198): Xaa can be any naturally occurring amino acid
  misc_feature (206)..(206): Xaa can be any naturally occurring amino acid
  misc_feature (226)..(226): Xaa can be any naturally occurring amino acid
  misc_feature (230)..(230): Xaa can be any naturally occurring amino acid
  misc_feature (233)..(233): Xaa can be any naturally occurring amino acid
  misc_feature (235)..(235): Xaa can be any naturally occurring amino acid
  misc_feature (237)..(237): Xaa can be any naturally occurring amino acid
  misc_feature (242)..(242): Xaa can be any naturally occurring amino acid
  misc_feature (248)..(248): Xaa can be any naturally occurring amino acid
  misc_feature (262)..(262): Xaa can be any naturally occurring amino acid
  misc_feature (268)..(269): Xaa can be any naturally occurring amino acid
  misc_feature (271)..(271): Xaa can be any naturally occurring amino acid
SRACRSTLVDPKRVCKGILEYLTVAEVVETMEDLVTYTKNLGPGMTKMAKMIDERQQELTHQEHRVMLVNSMNTVKELLPVLISAMKIFVTTKNSKNQGIEEALKNRNFTVEKMSAEINEIIRVLQLTSWDEDAWASKDTEAMKRALASIDSKLNQAKGWLRDPSASPGDAGEQAIRQILDEAGKVGELCAGKKRREXLGNLQNAXADDCQSGLTSVPRGQGSLPXGPCXKSXTXYXQGLGXCSPAKXEKASFQSWESLAHXKPKHLXXKXTMLV

SEQ ID NO: 637 - protein, 162 aa, Homo sapiens
QKLVIENFDDEQIWQQLELQNEPILQYFQNAVSETINDEDISLLPESEEQEREEDGSEIEADDKEDLEDLEEEEVSDMGNDDPEMGERAENSSKSDLRKSPVFSDEDSDLDFDISKLEQQSKVQNKGQGKPREKSIVDDKFFKLSEMEAYLENIEKEEEPKR

SEQ ID NO: 638 - protein, 171 aa, Homo sapiens
  misc_feature (12)..(12): Xaa can be any naturally occurring amino acid
  misc_feature (57)..(57): Xaa can be any naturally occurring amino acid
  misc_feature (59)..(59): Xaa can be any naturally occurring amino acid
  misc_feature (156)..(156): Xaa can be any naturally occurring amino acid
KMAAGFKTVEPXEYYRRFLKENCRPDGRELGEFRTTTVNIGSISTADGSALVKLGNXTXICGVKAEFAAPSTDAPDKGYVVPNVDLPPLCSSRFRSGPPGEEAQVASQFIADVIENSQIIQKEDLCISPGKLVWVLYCDLICLDYDGNILDACTFXLLAALKNVQVALKLL

SEQ ID NO: 639 - protein, 230 aa, Homo sapiens
  misc_feature (1)..(1): Xaa can be any naturally occurring amino acid
  misc_feature (201)..(201): Xaa can be any naturally occurring amino acid
  misc_feature (225)..(225): Xaa can be any naturally occurring amino acid
XSRACRSTLVDPKLKAKDQGKPEVGEYAKLEKINAEQQLKIQELQEKLEKAVKASTEATELLQNIRQAKERAERELEKLQNREDSSEGIRKKLVEAEERRHSLENKVKRLETMERRENRLKDDIQTKSQQIQQMADKILELEEKHREAQVSAQHLEVHLKQKEQHYEEKIKVLDNQIKKDLADKETLENMMQRHEEEAHEXGKILQRTEGDDQCYGFQDQIPGTXDCGTV

SEQ ID NO: 640 - protein, 256 aa, Homo sapiens
  misc_feature (177)..(177): Xaa can be any naturally occurring amino acid
  misc_feature (198)..(198): Xaa can be any naturally occurring amino acid
  misc_feature (211)..(211): Xaa can be any naturally occurring amino acid
  misc_feature (218)..(218): Xaa can be any naturally occurring amino acid
  misc_feature (226)..(226): Xaa can be any naturally occurring amino acid
  misc_feature (235)..(235): Xaa can be any naturally occurring amino acid
  misc_feature (238)..(238): Xaa can be any naturally occurring amino acid
  misc_feature (255)..(255): Xaa can be any naturally occurring amino acid
FEKDADSSERIIAPMRWGLVPSWFKESDPSKLQFNTTNCRSDTVMEKRSFKVPLGKGRRCVVLADGFYEWQRCQGTNQRQPYFIYFPQIKTEKSGSIGAADSPENWEKVWDNWRLLTMAGIFDCWEPPEGGDVLYSYTIITVDSCKGLSDIHHRMPAILDGEEAVSKWLDFGEVSTXEALKLIHPTENITFHAVSSVXNNSRNNTSECLAXVDLVVKXELKASGNXPKDVAMGWXQSXPKKEDSKTLQKEKVRCXP

SEQ ID NO: 641 - protein, 178 aa, Homo sapiens
QSNSPVLLSRLHFEKDADSSERIIAPMRWGLVPSWFKESDPSKLQFNTTNCRSDTVMEKRSFKVPLGKGRRCVVLADGFYEWQRCQGTNQRQPYFIYFPQIKTEKSGSIGAADSPENWEKVWDNWRLLTMAGIFDCWEPPEGGDVLYSYTIITVDSCKGLSDIHHRMPAILDGEEASF

SEQ ID NO: 642 - protein, 235 aa, Homo sapiens
  misc_feature (206)..(206): Xaa can be any naturally occurring amino acid
  misc_feature (226)..(227): Xaa can be any naturally occurring amino acid
  misc_feature (231)..(231): Xaa can be any naturally occurring amino acid
AVSVSCITYLRGIFPECAYGTRYLDDLCVKILREDKNCPGSTQLVKWMLGCYDALQKKYLRMVVLAVYTNPEDPQTISECYQFKFKYTNNGPLMDFISKNQSNESSMLSTDTKKASILLIRKIYILMQNLGPLPNDVCLTMKLFYYDEVTPPDYQPPGFKDGDCEGVIFEGEPMYLNVGEVSTPFHIFKVKVTTERERMENIDSTXLSPKQIKTPFQKILRDKDVXXEQDXYISG

SEQ ID NO: 643 - protein, 301 aa, Homo sapiens
  misc_feature (2)..(2): Xaa can be any naturally occurring amino acid
  misc_feature (6)..(6): Xaa can be any naturally occurring amino acid
  misc_feature (283)..(283): Xaa can be any naturally occurring amino acid
  misc_feature (285)..(285): Xaa can be any naturally occurring amino acid
  misc_feature (287)..(287): Xaa can be any naturally occurring amino acid
  misc_feature (298)..(299): Xaa can be any naturally occurring amino acid
TXLARXQVDTSGSKAMMLPVLTHHIRYHQCLMHLDKLIGYTFQDRCLLQLAMTHPSHHLNFGMNPDHARNSLSNCGIRQPKYGDRKVHHMHMRKKGINTLINIMSRLGQDDPTPSRINHNERLEFLGDAVVEFLTSVHLYYLFPSLEEGGLATYRTAIVQNQHLAMLAKKLELDRFMLYAHGPDLCRESDLRHAMANCFEALIGAVYLEGSLEEAKQLFGRLLFNDPDLREVWLNYPLHPLQLQEPNTDRQLIGNFFQFYKKLTEFERNQLGVNFLLIGSDFXAXGXSHLRNWGDLTXXTP

SEQ ID NO: 644 - protein, 163 aa, Homo sapiens
  misc_feature (5)..(6): Xaa can be any naturally occurring amino acid
  misc_feature (8)..(8): Xaa can be any naturally occurring amino acid
  misc_feature (162)..(162): Xaa can be any naturally occurring amino acid
PIMSXXTXSTLVDPKLCLVYVYMPNGSLLDRLSCLDGTPPLSWHMRCKIAQGAANGINFLHENHHIHRDIKSANILLDEAFTAKISDFGLARASEKFAQTVMTSRIVGTTAYMAPEALRGEITPKSDIYSFGVVLLEIITGLPAVDEHREPQLLLDIKRRNXR

SEQ ID NO: 645 - protein, 155 aa, Homo sapiens
  misc_feature (4)..(4): Xaa can be any naturally occurring amino acid
  misc_feature (37)..(37): Xaa can be any naturally occurring amino acid
  misc_feature (40)..(40): Xaa can be any naturally occurring amino acid
  misc_feature (54)..(54): Xaa can be any naturally occurring amino acid
  misc_feature (64)..(64): Xaa can be any naturally occurring amino acid
  misc_feature (81)..(81): Xaa can be any naturally occurring amino acid
  misc_feature (114)..(114): Xaa can be any naturally occurring amino acid
  misc_feature (124)..(124): Xaa can be any naturally occurring amino acid
  misc_feature (145)..(145): Xaa can be any naturally occurring amino acid
DYRXIEITICKNDECVLEDNSQRTKWKVISPTGNEAXVPXVCFLIPPPNKDAIXMASRVEQSYXKVMALWHQLHVNTKSLXSWNYLRKDLDLVQTWNLEKLRSSAPGECHQIMXNLQAHYEDFXQDSRDSVLVSVADRLRLEEEXEACKARFQHL

SEQ ID NO: 646 - protein, 200 aa, Homo sapiens
  misc_feature (4)..(4): Xaa can be any naturally occurring amino acid
  misc_feature (9)..(9): Xaa can be any naturally occurring amino acid
RGNXQGKAXSSETKESTDIEKAILEQQVLSEELTTKKEQVFEAIKTSQIFLAKHGHKLSEKEKKQISEQLNALNKAYHDLCDGSANQLQQLQSQLAHQTEQKECRAVAGVIDLGTVEIFPIFKAMQKGLLDQDTGLVLLESQVIMSGLIAPETGENLSLEEGVARNLINPQMYQQLRELQDALALISRLTESRGPLSVVE

SEQ ID NO: 647 - protein, 169 aa, Homo sapiens
KEQRKENEPEAEKTHLFAKQEKAFYPKSFKSKKQKPSRVLYSSTESSDEEALQNKKISTSCSVIPETSNSDMQTKKEYVVSGEHKQKGKVKRKLKNQNKNKENQELKQEKEGKENTRITNLTVNTGLDCSEKTREEGNFRKSFSPKDDTSLHLFHISTGKSPKHSCGLK

SEQ ID NO: 648 - protein, 139 aa, Homo sapiens
  misc_feature (7)..(7): Xaa can be any naturally occurring amino acid
  misc_feature (17)..(17): Xaa can be any naturally occurring amino acid
  misc_feature (20)..(20): Xaa can be any naturally occurring amino acid
  misc_feature (26)..(26): Xaa can be any naturally occurring amino acid
  misc_feature (34)..(34): Xaa can be any naturally occurring amino acid
  misc_feature (52)..(52): Xaa can be any naturally occurring amino acid
  misc_feature (59)..(59): Xaa can be any naturally occurring amino acid
  misc_feature (66)..(66): Xaa can be any naturally occurring amino acid
  misc_feature (69)..(69): Xaa can be any naturally occurring amino acid
  misc_feature (73)..(73): Xaa can be any naturally occurring amino acid
  misc_feature (75)..(75): Xaa can be any naturally occurring amino acid
  misc_feature (80)..(80): Xaa can be any naturally occurring amino acid
  misc_feature (83)..(84): Xaa can be any naturally occurring amino acid
  misc_feature (86)..(86): Xaa can be any naturally occurring amino acid
  misc_feature (102)..(102): Xaa can be any naturally occurring amino acid
  misc_feature (106)..(106): Xaa can be any naturally occurring amino acid
  misc_feature (110)..(110): Xaa can be any naturally occurring amino acid
  misc_feature (112)..(112): Xaa can be any naturally occurring amino acid
  misc_feature (117)..(118): Xaa can be any naturally occurring amino acid
  misc_feature (122)..(122): Xaa can be any naturally occurring amino acid
  misc_feature (125)..(126): Xaa can be any naturally occurring amino acid
  misc_feature (135)..(135): Xaa can be any naturally occurring amino acid
  misc_feature (137)..(137): Xaa can be any naturally occurring amino acid
AFLFPSXYASIYVFLMXYLXYPFFSXGNLNFQMXDYDLHPLFWHLIFHQILXGNLSDVXFFPYAYXILXLNFXAXIQILXYHXXQXQAVMTFQNFLGINMFXYVLXLGGXTXFHLIXXNVWXIYXXKYEINVMKXHXLG

SEQ ID NO: 649 - protein, 321 aa, Homo sapiens
GKDLLNMYIETEGKMIMQDKLEKERNDAKNAVEEYVYEFRDKLCGPYEKFICEQDHQNFLRLLTETEDWLYEEGEDQAKQAYVDKLEELMKIGTPVKVRFQEAEERPKMFEELGQRLQHYAKIAADFRNKDEKYNHIDESEMKKVEAKQAYVDKLEELMKIGTPVKVRFQEAEERPKMFEELGQRLQHYAKIAADFRNKDEKYNHIDESEMKKVEKSVNEVMEWMNNVMNAQAKKSLDQDPVVRAQEIKTKIKELNNTCEPVVTQPKPKIESPKLERTPNGPNIDKKEEDLEDKNNFGAEPPHQNGECYPNEKNSVNMDLD

SEQ ID NO: 650 - protein, 188 aa, Homo sapiens
CAILSPAFKVREFSVTDAVPFPISLIWNHDSEDTEGVHEVFSRNHAAPFSKVLTFLRRGPFELEAFYSDPQGVPYPEAKIGRFVVQNVSAQKDGEKSRVKVKVRVNTHGIFTISTASMVEKVPTEENEMSSEADMECLNQRPPENPDTDANEKKVDQPPEAKKPKIKVVNVELPIEANLVWQLGERPS

SEQ ID NO: 651 - protein, 174 aa, Homo sapiens
  misc_feature (1)..(1): Xaa can be any naturally occurring amino acid
  misc_feature (3)..(3): Xaa can be any naturally occurring amino acid
  misc_feature (5)..(5): Xaa can be any naturally occurring amino acid
  misc_feature (9)..(11): Xaa can be any naturally occurring amino acid
  misc_feature (21)..(21): Xaa can be any naturally occurring amino acid
  misc_feature (23)..(25): Xaa can be any naturally occurring amino acid
  misc_feature (27)..(27): Xaa can be any naturally occurring amino acid
  misc_feature (29)..(29): Xaa can be any naturally occurring amino acid
  misc_feature (37)..(37): Xaa can be any naturally occurring amino acid
  misc_feature (41)..(42): Xaa can be any naturally occurring amino acid
  misc_feature (46)..(46): Xaa can be any naturally occurring amino acid
  misc_feature (48)..(48): Xaa can be any naturally occurring amino acid
  misc_feature (50)..(51): Xaa can be any naturally occurring amino acid
  misc_feature (56)..(56): Xaa can be any naturally occurring amino acid
  misc_feature (59)..(59): Xaa can be any naturally occurring amino acid
  misc_feature (61)..(64): Xaa can be any naturally occurring amino acid
  misc_feature (67)..(67): Xaa can be any naturally occurring amino acid
  misc_feature (73)..(74): Xaa can be any naturally occurring amino acid
  misc_feature (76)..(76): Xaa can be any naturally occurring amino acid
  misc_feature (81)..(81): Xaa can be any naturally occurring amino acid
  misc_feature (83)..(83): Xaa can be any naturally occurring amino acid
  misc_feature (86)..(86): Xaa can be any naturally occurring amino acid
  misc_feature (93)..(93): Xaa can be any naturally occurring amino acid
  misc_feature (95)..(95): Xaa can be any naturally occurring amino acid
  misc_feature (97)..(97): Xaa can be any naturally occurring amino acid
  misc_feature (100)..(100): Xaa can be any naturally occurring amino acid
  misc_feature (112)..(113): Xaa can be any naturally occurring amino acid
  misc_feature (116)..(117): Xaa can be any naturally occurring amino acid
  misc_feature (129)..(129): Xaa can be any naturally occurring amino acid
  misc_feature (147)..(147): Xaa can be any naturally occurring amino acid
  misc_feature (155)..(155): Xaa can be any naturally occurring amino acid
  misc_feature (168)..(168): Xaa can be any naturally occurring amino acid
XIXKXIGKXXXGLKPVGNLVXVXXXLXGXYEKFICEXVFKXXDDAXQXLXXAVSGXGGXSXXXXRCXVAGLRXXGXPVKVXFXEHXNGQKCFXTXQXLQXYPKIAADFRNKXXKSXXIDEFEMKKVEKXVNEVMEWMNNVMNAQAKXSFDQDPVXRAQEIKTKIKELXTHVNPL

SEQ ID NO: 652 - protein, 150 aa, Homo sapiens
  misc_feature (4)..(4): Xaa can be any naturally occurring amino acid
  misc_feature (8)..(9): Xaa can be any naturally occurring amino acid
  misc_feature (11)..(12): Xaa can be any naturally occurring amino acid
  misc_feature (15)..(15): Xaa can be any naturally occurring amino acid
  misc_feature (25)..(25): Xaa can be any naturally occurring amino acid
  misc_feature (28)..(28): Xaa can be any naturally occurring amino acid
  misc_feature (37)..(38): Xaa can be any naturally occurring amino acid
  misc_feature (45)..(45): Xaa can be any naturally occurring amino acid
  misc_feature (54)..(54): Xaa can be any naturally occurring amino acid
  misc_feature (67)..(67): Xaa can be any naturally occurring amino acid
  misc_feature (75)..(75): Xaa can be any naturally occurring amino acid
  misc_feature (93)..(93): Xaa can be any naturally occurring amino acid
  misc_feature (105)..(106): Xaa can be any naturally occurring amino acid
  misc_feature (109)..(110): Xaa can be any naturally occurring amino acid
  misc_feature (122)..(122): Xaa can be any naturally occurring amino acid
  misc_feature (125)..(125): Xaa can be any naturally occurring amino acid
  misc_feature (127)..(127): Xaa can be any naturally occurring amino acid
  misc_feature (129)..(129): Xaa can be any naturally occurring amino acid
  misc_feature (136)..(136): Xaa can be any naturally occurring amino acid
  misc_feature (139)..(139): Xaa can be any naturally occurring amino acid
  misc_feature (141)..(141): Xaa can be any naturally occurring amino acid
  misc_feature (146)..(146): Xaa can be any naturally occurring amino acid
  misc_feature (148)..(149): Xaa can be any naturally occurring amino acid
GNIXHSDXXVXXQNXFWLLNLLPFXQYXGHLEFFPVXXIQFLVSXGLQRVHMCXQFLDFCFNFLSPXNWILIKTXFSLSIHDIIHPFHHFINXLLHFFHFKLINXXGFXXLISEVSCYLGIXLQXLXSXKTFLAVXMFXKXNFHWXAXXP

SEQ ID NO: 653 - protein, 155 aa, Homo sapiens
  misc_feature (3)..(3): Xaa can be any naturally occurring amino acid
  misc_feature (20)..(20): Xaa can be any naturally occurring amino acid
  misc_feature (26)..(26): Xaa can be any naturally occurring amino acid
  misc_feature (82)..(82): Xaa can be any naturally occurring amino acid
  misc_feature (89)..(89): Xaa can be any naturally occurring amino acid
  misc_feature (110)..(110): Xaa can be any naturally occurring amino acid
  misc_feature (112)..(112): Xaa can be any naturally occurring amino acid
  misc_feature (116)..(116): Xaa can be any naturally occurring amino acid
  misc_feature (139)..(139): Xaa can be any naturally occurring amino acid
  misc_feature (141)..(141): Xaa can be any naturally occurring amino acid
AEXAALCQDSSCFRNKDEKXTHIDEXEMKKVEKSVNEVMEWMNNVMNAQAKKSLDQDPVVRAQEIKPKIKELNNTCEPVVTXPKPKIEXPKLERTPNGPNIDKKEEDLEXKXNFGXEPPHQNGECYPNEKNSVNMDLDXIXLNWPIPSINKIFLP

SEQ ID NO: 654 - protein, 188 aa, Homo sapiens; identical to SEQ ID NO: 650

SEQ ID NO: 655 - protein, 138 aa, Homo sapiens
  misc_feature (20)..(20): Xaa can be any naturally occurring amino acid
  misc_feature (82)..(82): Xaa can be any naturally occurring amino acid
  misc_feature (117)..(117): Xaa can be any naturally occurring amino acid
AEAAALCQDSSCFRNKDEKXTHIDESEMKKVEKSVNEVMEWMNNVMNAQAKKSLDQDPVVRAQEIKTKIKELTNTCEPVVTXPKPKIESPKLERTPNGPNIDKKEEDLEDKNNFGAXPPHQNGECYPNEKNSVNMDLD

SEQ ID NO: 656 - protein, 110 aa, Homo sapiens
  misc_feature (2)..(2): Xaa can be any naturally occurring amino acid
  misc_feature (15)..(15): Xaa can be any naturally occurring amino acid
  misc_feature (25)..(25): Xaa can be any naturally occurring amino acid
  misc_feature (37)..(37): Xaa can be any naturally occurring amino acid
  misc_feature (53)..(53): Xaa can be any naturally occurring amino acid
  misc_feature (55)..(55): Xaa can be any naturally occurring amino acid
  misc_feature (57)..(57): Xaa can be any naturally occurring amino acid
  misc_feature (70)..(70): Xaa can be any naturally occurring amino acid
  misc_feature (75)..(76): Xaa can be any naturally occurring amino acid
  misc_feature (80)..(83): Xaa can be any naturally occurring amino acid
  misc_feature (87)..(88): Xaa can be any naturally occurring amino acid
  misc_feature (92)..(92): Xaa can be any naturally occurring amino acid
  misc_feature (94)..(95): Xaa can be any naturally occurring amino acid
RXRQRLQHYAKIAAXFRNKDEKSPXIDEFEMKKVEKXVNEVMEWMNNVMNAQXKXSXDQDPVVRAQEINXKSRNXXTHVXXXXPNRXXKLNXPXXKELQMAQILIKRKKI

SEQ ID NO: 657 - protein, 138 aa, Homo sapiens
  misc_feature (32)..(32): Xaa can be any naturally occurring amino acid
  misc_feature (34)..(34): Xaa can be any naturally occurring amino acid
  misc_feature (52)..(52): Xaa can be any naturally occurring amino acid
  misc_feature (61)..(61): Xaa can be any naturally occurring amino acid
  misc_feature (67)..(67): Xaa can be any naturally occurring amino acid
  misc_feature (73)..(75): Xaa can be any naturally occurring amino acid
  misc_feature (82)..(82): Xaa can be any naturally occurring amino acid
  misc_feature (85)..(85): Xaa can be any naturally occurring amino acid
  misc_feature (89)..(89): Xaa can be any naturally occurring amino acid
  misc_feature (91)..(91): Xaa can be any naturally occurring amino acid
  misc_feature (96)..(96): Xaa can be any naturally occurring amino acid
  misc_feature (110)..(113): Xaa can be any naturally occurring amino acid
  misc_feature (115)..(116): Xaa can be any naturally occurring amino acid
  misc_feature (118)..(119): Xaa can be any naturally occurring amino acid
  misc_feature (123)..(123): Xaa can be any naturally occurring amino acid
  misc_feature (132)..(132): Xaa can be any naturally occurring amino acid
AEAAALCQDSSCFRNKDEKSPHIDEFEMKKVXKXVNEVMEWMNNVMNAQAKXSFDQDPVVXAQEIKXKIKELXXXCEPVVTXPKXKIEXPXLERTXNGPNIDKKEEDLEXXXXFXXEXXHQNXECYPNEKNXVNMDLD

SEQ ID NO: 658 - protein, 133 aa, Homo sapiens
GKMIMQDKLEKERNDAKNAVEEYVYEFRDKLCGPYEKFICEQDHQNFLRLLTETEDWLYEEGEDQAKQAYVDKLEELMKIGTPVKVRFQEAEERPKMFEELGQRLQHYAKIAADFRNKDEKYNHIDESEMKKV

SEQ ID NO: 659 - protein, 118 aa, Homo sapiens
  misc_feature (7)..(7): Xaa can be any naturally occurring amino acid
  misc_feature (15)..(15): Xaa can be any naturally occurring amino acid
  misc_feature (17)..(17): Xaa can be any naturally occurring amino acid
  misc_feature (29)..(29): Xaa can be any naturally occurring amino acid
  misc_feature (32)..(32): Xaa can be any naturally occurring amino acid
  misc_feature (39)..(39): Xaa can be any naturally occurring amino acid
  misc_feature (45)..(45): Xaa can be any naturally occurring amino acid
  misc_feature (54)..(54): Xaa can be any naturally occurring amino acid
  misc_feature (74)..(75): Xaa can be any naturally occurring amino acid
  misc_feature (80)..(80): Xaa can be any naturally occurring amino acid
  misc_feature (85)..(85): Xaa can be any naturally occurring amino acid
  misc_feature (92)..(92): Xaa can be any naturally occurring amino acid
  misc_feature (97)..(97): Xaa can be any naturally occurring amino acid
  misc_feature (103)..(103): Xaa can be any naturally occurring amino acid
  misc_feature (105)..(105): Xaa can be any naturally occurring amino acid
  misc_feature (108)..(108): Xaa can be any naturally occurring amino acid
FLFINIXAIWSSFQXGXFNFWFRLGYNGXTCXGQFLDFXFNFLSXYNWILIKTXFSLSIHDIIHPFHHFINRLXXFFHFXLINMXGFLILIXEVSCXLGIMLXPXPSXSNILGRSSAS

SEQ ID NO: 660 - protein, 141 aa, Homo sapiens
  misc_feature (1)..(1): Xaa can be any naturally occurring amino acid
  misc_feature (4)..(4): Xaa can be any naturally occurring amino acid
  misc_feature (6)..(6): Xaa can be any naturally occurring amino acid
  misc_feature (12)..(12): Xaa can be any naturally occurring amino acid
  misc_feature (17)..(17): Xaa can be any naturally occurring amino acid
  misc_feature (24)..(24): Xaa can be any naturally occurring amino acid
  misc_feature (29)..(29): Xaa can be any naturally occurring amino acid
  misc_feature (34)..(35): Xaa can be any naturally occurring amino acid
  misc_feature (55)..(55): Xaa can be any naturally occurring amino acid
  misc_feature (64)..(64): Xaa can be any naturally occurring amino acid
  misc_feature (70)..(70): Xaa can be any naturally occurring amino acid
  misc_feature (77)..(77): Xaa can be any naturally occurring amino acid
  misc_feature (80)..(80): Xaa can be any naturally occurring amino acid
  misc_feature (92)..(92): Xaa can be any naturally occurring amino acid
  misc_feature (94)..(94): Xaa can be any naturally occurring amino acid
  misc_feature (102)..(102): Xaa can be any naturally occurring amino acid
  misc_feature (113)..(113): Xaa can be any naturally occurring amino acid
  misc_feature (115)..(115): Xaa can be any naturally occurring amino acid
  misc_feature (118)..(118): Xaa can be any naturally occurring amino acid
XTRXRXQHYAKXAADFXNKDEKSXHIDEXEMKKXXKSVNEVMEWMNNVMNAQAKXSLDQDPVVXAQEIKXKIKELTXTCXPVVTQPKPKIEXPXLERTPNGXNIDKKEEDLEXKXNFXGEPPHQNGECYPNEKNSVNMDLD

SEQ ID NO: 661 - protein, 175 aa, Homo sapiens
AKQAYVDKLEELMKIGTPVKVRFQEAEERPKMFEELGQRLQHYAKIAADFRNKDEKYNHIDESEMKKVEKSVNEVMEWMNNVMNAQAKKSLDQDPVVRAQEIKTKIKELNNTCEPVVTQPKPKIESPKLERTPNGPNIDKKEEDLEDKNNFGAEPPHQNGECYPNEKNSVNMDLD

SEQ ID NO: 662 - protein, 120 aa, Homo sapiens
  misc_feature (65)..(65): Xaa can be any naturally occurring amino acid
  misc_feature (72)..(73): Xaa can be any naturally occurring amino acid
  misc_feature (76)..(76): Xaa can be any naturally occurring amino acid
  misc_feature (79)..(79): Xaa can be any naturally occurring amino acid
  misc_feature (83)..(84): Xaa can be any naturally occurring amino acid
  misc_feature (109)..(109): Xaa can be any naturally occurring amino acid
ETEGKMIMQDKLEKERNDAKNAVEEYVYEFRDKLCGPYEKFICEQDHQNFLRLLTETEDWLYEEXEDQAKQXXVDXLEXLMKXXTPVKVRFQEAEERPKMFEELGQRLXHYAKIAADFKK

SEQ ID NO: 663 - protein, 79 aa, Homo sapiens
  misc_feature (1)..(1): Xaa can be any naturally occurring amino acid
  misc_feature (4)..(4): Xaa can be any naturally occurring amino acid
  misc_feature (7)..(8): Xaa can be any naturally occurring amino acid
  misc_feature (15)..(15): Xaa can be any naturally occurring amino acid
XFQXVDXXLFSLVLXFFIQPVFSFCEESQKILMILLTYKFFIWSTQLVSELIHIFLNCIFSIIPFFFQFILHYHLTLCL

SEQ ID NO: 664 - protein, 97 aa, Homo sapiens
MNNVMNAQAKKSLDQDPVVRAQEIKTKIKELNNTCEPVVTQPKPKIESPKLERTPNGPNIDKKEEDLEDKNNFGAEPPHQNGECYPNEKNSVNMDLD

SEQ ID NO: 665 - protein, 178 aa, Homo sapiens
EDQAKQAYVDKLEELMKIGTPVKVRFQEAEERPKMFEELGQRLQHYAKIAADFRNKDEKYNHIDESEMKKVEKSVNEVMEWMNNVMNAQAKKSLDQDPVVRAQEIKTKIKELNNTCEPVVTQPKPKIESPKLERTPNGPNIDKKEEDLEDKNNFGAEPPHQNGECYPNEKNSVNMDLD

SEQ ID NO: 666 - protein, 198 aa, Homo sapiens
  misc_feature (189)..(189): Xaa can be any naturally occurring amino acid
  misc_feature (194)..(194): Xaa can be any naturally occurring amino acid
GRQPEVRSDLRRLSPAFSQGFLSASRRCPRGSRRLLTGRGCLCVLLSVRGTARPRGPEQNAARAESGGRRSRQGAGGRRPRPEAEADREPAMSVVGLDVGSQSCYIAVARAGGIETIANEFSDRCTPSVISFGSKNRTIGVAAKNQQITHANNTVSNFKRFHGRAFNDPFIQKEKGKLELRFGSIEKWXSWNKXNVHG

SEQ ID NO: 667 - protein, 100 aa, Homo sapiens
  misc_feature (35)..(35): Xaa can be any naturally occurring amino acid
  misc_feature (51)..(51): Xaa can be any naturally occurring amino acid
  misc_feature (55)..(55): Xaa can be any naturally occurring amino acid
  misc_feature (71)..(71): Xaa can be any naturally occurring amino acid
  misc_feature (82)..(82): Xaa can be any naturally occurring amino acid
  misc_feature (97)..(97): Xaa can be any naturally occurring amino acid
TSTPTHMLNGEQNARKLPWQEQMLKDFNHSPLEQXVQFFFSKRQKSVSSSXMQMXRLHRKLSMNSQFHRNXKVTKAIFPFRXIKTTDLSFFLFPYNXQKF

SEQ ID NO: 668 - protein, 141 aa, Homo sapiens
  misc_feature (59)..(59): Xaa can be any naturally occurring amino acid
  misc_feature (72)..(72): Xaa can be any naturally occurring amino acid
  misc_feature (85)..(85): Xaa can be any naturally occurring amino acid
  misc_feature (101)..(101): Xaa can be any naturally occurring amino acid
  misc_feature (119)..(119): Xaa can be any naturally occurring amino acid
  misc_feature (122)..(122): Xaa can be any naturally occurring amino acid
  misc_feature (125)..(125): Xaa can be any naturally occurring amino acid
  misc_feature (128)..(128): Xaa can be any naturally occurring amino acid
  misc_feature (133)..(133): Xaa can be any naturally occurring amino acid
GRQPEVRSDLRRLSPAFSQGFLSASRRCPRGSRRLLTGRGCLCVLLSVRGTARPRGPEXNAARAESGGRRSXQGAGGRRPRPEAXADREPAMSVVGLDVGXQSCYIAVARAGGIETIAXEFXDRXTPXVISFXSKNINKSE

SEQ ID NO: 669 - protein, 116 aa, Homo sapiens
  misc_feature (3)..(3): Xaa can be any naturally occurring amino acid
  misc_feature (19)..(19): Xaa can be any naturally occurring amino acid
  misc_feature (33)..(33): Xaa can be any naturally occurring amino acid
  misc_feature (45)..(45): Xaa can be any naturally occurring amino acid
QLXEPTSNPTTDMAGSRSXSASGLGLRPPAPCXLLLPPLSALAAXCSGPRGLAVPLTLRRTHRQPRPVRSLLLPRGQRRLADKKPWEKAGLSLRRSLRTSGCLPHSAAARTPAPAL

SEQ ID NO: 670 - protein, 107 aa, Homo sapiens
  misc_feature (3)..(3): Xaa can be any naturally occurring amino acid
  misc_feature (6)..(6): Xaa can be any naturally occurring amino acid
  misc_feature (9)..(9): Xaa can be any naturally occurring amino acid
  misc_feature (12)..(12): Xaa can be any naturally occurring amino acid
  misc_feature (30)..(30): Xaa can be any naturally occurring amino acid
  misc_feature (46)..(46): Xaa can be any naturally occurring amino acid
  misc_feature (59)..(59): Xaa can be any naturally occurring amino acid
  misc_feature (72)..(72): Xaa can be any naturally occurring amino acid
YDXRGXPVXELXGDGLDAPGPGYRDVAALXAHVQPHHRHGRLAVRXRLGSRSASSGPLXASPAAAFCPGRVXLRPAGSGRSSDTQKDTQTAAACQEPPTPPGTAAAG

SEQ ID NO: 671 - protein, 139 aa, Homo sapiens
GNVCKWGPVHVSVWCACGNVCKWAPVRVCGVCVGMCASGRLCECVVRVWECVQVGACPCECVVRVLECVQVDACACECVVRVGMCASGHLCECVVRVWECVQVGTCPWECVVRVWECVQVGACACECEDTSCSGVTNPI

SEQ ID NO: 672 - protein, 139 aa, Homo sapiens
VCGVHVGMCASGRLCECVVCVWECVQVGACASVWCVCGNVCKWAPAHVSVWCVCWNVCKWTPAHVSVWCVWECVQVGTCASVWCACGNVCKWAPAHGSVWCACGNVCKWEPAHVSVRTPRAQVSPTPFKKEITMMTTSL

SEQ ID NO: 673 - protein, 134 aa, Homo sapiens
HLSTRCPHTHMRRLPLAHIPTRAPHTPMGRCPLAHIPTRAPHTRTGAHLHTFPHAPHTHMRRRPLAHIPTHAPHTHMGRRPLAHIPTHAPHTRTGAHLHTFPHTHHTLAQAPTCTHSHMHTTHSHAQAPTCTHS

SEQ ID NO: 674 - protein, 132 aa, Homo sapiens
ARGVLTLTCAGSHLHTFPHAHHTLPWAGAHLHTFPHAHHTLAQVPTCTHSHTHHTLTCAGVHLHTFQHTHHTLTWAGAHLHTFPHTHHTLAQAPTCTHSHTHTTHSHRRPLAHIPTCTPHTHMHRPPLAHIP

SEQ ID NO: 675 - protein, 138 aa, Homo sapiens
MGLVTPEHEVSSHSHAQAPTCTHSHTRTTHSHGQVPTCTHSHTRTTHSHRCPLAHIPTRTTHSHAQASTCTHSNTRTTHSHGQAPTCTHSHTRTTHSHRRPLAHIPTHTPHTRTGAHLHTFPHAHHTLTCTGPHLHTF

SEQ ID NO: 676 - protein, 96 aa, Homo sapiens
  misc_feature (47)..(47): Xaa can be any naturally occurring amino acid
  misc_feature (79)..(79): Xaa can be any naturally occurring amino acid
MESKMQENYLGRNKCLKILITALLNKQYKFFFSKRQKSVSSSVMQMXRLHRKLSMNSQFHRNLKVTKAIFPFRIIKTTXLKLFFFFHIIHKISKYP

SEQ ID NO: 677 - protein, 178 aa, Homo sapiens; identical to SEQ ID NO: 665

SEQ ID NO: 678 - protein, 215 aa, Homo sapiens
ENEMSSEADMECLNQRPPENPDTDKNVQQDNSEAGTQPQVQTDAQQTSQSPPSPELTSEENKIPDADKANEKKVDQPPEAKKPKIKVVNVELPIEANLVWQLGKDLLNMYIETEGKMIMQDKLEKERNDAKNAVEEYVYEFRDKLCGPYEKFICEQDHQNFLRLLTETEDWLYEEGEDQAKQAYVDKLEELMKIGTPVKVRFQEAERTAQKCLKN

SEQ ID NO: 679 - protein, 233 aa, Homo sapiens
SDPQGVPYPEAKIGRFVVQNVSAQKDGEKSRVKVKVRVNTHGIFTISTASMVEKVPTEENEMSSEADMECLNQRPPENPDTDKNVQQDNSEAGTQPQVQTDAQQTSQSPPSPELTSEENKIPDADKANEKKVDQPPEAKKPKIKVVNVELPIEANLVWQLGKDLLNMYIETEGKMIMQDKLEKERNDAKNAVEEYVYEFRDKLCGPYEKFICEQDHQKFFEDSSQKTGRTGLF

SEQ ID NO: 680 - protein, 471 aa, Homo sapiens
  misc_feature (84)..(84): Xaa can be any naturally occurring amino acid
LDMAPEINLPGPMSLIDNTKGQLVVNPEALKILSAITQPVVVVAIVGLYRTGKSYLMNKLAGKKNGFSLGSTVKSHTKGIWMWXVPHPKKPEHTLVLLDTEGLGDIEKGDNENDSWIFALAILLSSTFVYNSMGTINQQAMDQLHYVTELTDRIKANSSPGNNSVDDSADFVSFFPAFVWTLRDFTLELEVDGEPITADDYLELSLKLRKGTDKKSKSFNDPRLCIRKFFPKRKCFVFDWPAPKKYLAHLEQLKEEELNPDFIEQVAEFCSYILSHSNVKTLSGGIAVNGPRLESLVLTYVNAISSGDLPCMENAVLALAQIENSAAVEKAIAHYEQQMGQKVQLPTETLQELLDLHRDSEREAIEVFMKNSFKDVDQMFQRKLGAQLEARRDDFCKQNSKASSDCCMALLQDIFGPLEEDVKQGTFSKPGGYRLFTQKLQELKNKSTRAKEGDTGQRGAEKIFGVQGGCG

SEQ ID NO: 681 - protein, 198 aa, Homo sapiens
  misc_feature (84)..(84): Xaa can be any naturally occurring amino acid
  misc_feature (158)..(158): Xaa can be any naturally occurring amino acid
  misc_feature (169)..(169): Xaa can be any naturally occurring amino acid
  misc_feature (184)..(184): Xaa can be any naturally occurring amino acid
LDMAPEINLPGPMSLIDNTKGQLVVNPEALKILSAITQPVVVVAIVGLYRTGKSYLMNKLAGKKNGFSLGSTVKSHTKGIWMWXVPHPKKPEHTLVLLDTEGLGDIEKGDNENDSWIFALAILLSSTFVYNSMGTINQQAMDQLHYVTELTDRIKANXSPGNNSVDDSXDFVSFFPAFVWTLKXFTLELGSRWRTHHC

SEQ ID NO: 682 - protein, 147 aa, Homo sapiens
  misc_feature (15)..(15): Xaa can be any naturally occurring amino acid
  misc_feature (23)..(23): Xaa can be any naturally occurring amino acid
  misc_feature (64)..(64): Xaa can be any naturally occurring amino acid
SPGAKGRGYKAKEVXKKYLESKXDVADALLQTDQSLSEKEKAIEVERIKAESAEAAKKMLEEIXKKNEEMMEQKEKSYQEHVKQLTEKMERDRAQLMAEQEKTLALKLQEQERLLKEGFENESKRLQKDIWDIQMRSKSLEPICNIL

SEQ ID NO: 683 - protein, 105 aa, Homo sapiens
  misc_feature (42)..(42): Xaa can be any naturally occurring amino acid
  misc_feature (84)..(84): Xaa can be any naturally occurring amino acid
  misc_feature (92)..(92): Xaa can be any naturally occurring amino acid
ERGSSLALPLTGPCPSPSSQSIVSHVPDNSSLSVPSSPHSSXVFPPTFSLQLLQIQPLYVPLQSLFPFLRVTDQSVEVHQPHPXWTPNIFSXPLWPCIPFLWHLG

SEQ ID NO: 684 - protein, 274 aa, Homo sapiens
  misc_feature (208)..(208): Xaa can be any naturally occurring amino acid
  misc_feature (213)..(213): Xaa can be any naturally occurring amino acid
  misc_feature (235)..(235): Xaa can be any naturally occurring amino acid
  misc_feature (239)..(240): Xaa can be any naturally occurring amino acid
  misc_feature (245)..(245): Xaa can be any naturally occurring amino acid
  misc_feature (253)..(253): Xaa can be any naturally occurring amino acid
  misc_feature (266)..(266): Xaa can be any naturally occurring amino acid
ILLSSTFVYNSMGTINQQAMDQLHYVTELTDRIKANSSPGNNSVDDSADFVSFFPAFVWTLRDFTLELEVDGEPITADDYLELSLKLRKGTDKKSKSFNDPRLCIRKFFPKRKCFVFDWPAPKKYLAHLEQLKEEELNPDFIEQVAEFCSYILSHSNVKTLSGGIAVNGPRLESLVLTYVNAIGSGDLPCMENAVLALAQIEELSPQXKRLLXTYEQQDGARRGSCPPETLPGAXGTCXXTVRKXAIEVFIEXTFFKDVGPNGSKXKLGGPIWE

SEQ ID NO: 685 - protein, 120 aa, Homo sapiens
  misc_feature (3)..(3): Xaa can be any naturally occurring amino acid
  misc_feature (8)..(8): Xaa can be any naturally occurring amino acid
  misc_feature (24)..(24): Xaa can be any naturally occurring amino acid
  misc_feature (50)..(50): Xaa can be any naturally occurring amino acid
  misc_feature (56)..(56): Xaa can be any naturally occurring amino acid
  misc_feature (59)..(61): Xaa can be any naturally occurring amino acid
  misc_feature (63)..(63): Xaa can be any naturally occurring amino acid
  misc_feature (65)..(65): Xaa can be any naturally occurring amino acid
  misc_feature (74)..(74): Xaa can be any naturally occurring amino acid
  misc_feature (78)..(79): Xaa can be any naturally occurring amino acid
  misc_feature (86)..(86): Xaa can be any naturally occurring amino acid
  misc_feature (88)..(88): Xaa can be any naturally occurring amino acid
  misc_feature (92)..(92): Xaa can be any naturally occurring amino acid
  misc_feature (99)..(99): Xaa can be any naturally occurring amino acid
CTXTADQXLSEKEKAIEVERIKVXSAEAAKKMLEEIQKKNEEMMDQKEKXYQEHVXQLXXXMXRXRAQLMAEQXKPLXXKLQEQEXLXKEGXENESKRXQKDIWDIQMRSKSLEPICNIL

SEQ ID NO: 686 - protein, 205 aa, Homo sapiens
PMSLIDNTKGQLVVNPEALKILSAITQPVVVVAIVGLYRTGKSYLMNKLAGKKNGFSLGSTVKSHTKGIWMWCVPHPKKPEHTLVLLDTEGLGDIEKGDNENDSWIFALAILLSSTFVYNSMGTINQQAMDQLHYVTELTDRIKANSSPGNNSVDDSADFVSFFPAFVWTLRDFTLELEVDGEPITADDYLELSLKLRKGTDKEK

SEQ ID NO: 687 - protein, 111 aa, Homo sapiens
  misc_feature (17)..(18): Xaa can be any naturally occurring amino acid
  misc_feature (24)..(24): Xaa can be any naturally occurring amino acid
  misc_feature (28)..(28): Xaa can be any naturally occurring amino acid
  misc_feature (46)..(46): Xaa can be any naturally occurring amino acid
  misc_feature (54)..(54): Xaa can be any naturally occurring amino acid
  misc_feature (57)..(57): Xaa can be any naturally occurring amino acid
  misc_feature (60)..(60): Xaa can be any naturally occurring amino acid
  misc_feature (93)..(93): Xaa can be any naturally occurring amino acid
KRLSTGTIFLTQEVPVXXSKCRSXRISXPRVPKEGDTGNLPAKEVXKNIWSPRXMGXCTXTDCQSLFKKEKAIEVDGIKAEFAEAAKKMLEEXQKKNEEMMARKRRVIRNM

SEQ ID NO: 688 - protein, 115 aa, Homo sapiens
  misc_feature (7)..(7): Xaa can be any naturally occurring amino acid
  misc_feature (11)..(11): Xaa can be any naturally occurring amino acid
  misc_feature (13)..(13): Xaa can be any naturally occurring amino acid
  misc_feature (22)..(22): Xaa can be any naturally occurring amino acid
  misc_feature (39)..(39): Xaa can be any naturally occurring amino acid
  misc_feature (43)..(43): Xaa can be any naturally occurring amino acid
  misc_feature (49)..(49): Xaa can be any naturally occurring amino acid
  misc_feature (51)..(51): Xaa can be any naturally occurring amino acid
  misc_feature (72)..(73): Xaa can be any naturally occurring amino acid
  misc_feature (78)..(78): Xaa can be any naturally occurring amino acid
  misc_feature (93)..(93): Xaa can be any naturally occurring amino acid
  misc_feature (95)..(95): Xaa can be any naturally occurring amino acid
  misc_feature (99)..(99): Xaa can be any naturally occurring amino acid
  misc_feature (106)..(106): Xaa can be any naturally occurring amino acid
  misc_feature (109)..(109): Xaa can be any naturally occurring amino acid
KVTDSLXKCIXPXSLDSKYFFXPLWPGGYLYPLPWAPWXDLFXSSCTLXKXPEPPGLKKWSLLTIFFKRAQXXLEVKXCHKSDDAFGILLTKXIXPLVXTGALNSXGQXGPHPWK

SEQ ID NO: 689 - protein, 133 aa, Homo sapiens
  misc_feature (43)..(43): Xaa can be any naturally occurring amino acid
  misc_feature (97)..(97): Xaa can be any naturally occurring amino acid
  misc_feature (100)..(100): Xaa can be any naturally occurring amino acid
  misc_feature (104)..(105): Xaa can be any naturally occurring amino acid
  misc_feature (119)..(119): Xaa can be any naturally occurring amino acid
  misc_feature (121)..(121): Xaa can be any naturally occurring amino acid
  misc_feature (127)..(127): Xaa can be any naturally occurring amino acid
ERGSSLALPLTGPCPSPSSQSIVSHVPDNSSLSGHHLLILLLXFLQHFLCSFCRFSLYTVPLQSLFPFLRVTDQVCRSASTTSSLDSKYFFSTSLAXIPXLGPXXLILQLLQLLSKKTXTXWVKKRXLLDIFF

SEQ ID NO: 690 - protein, 112 aa, Homo sapiens
  misc_feature (11)..(11): Xaa can be any naturally occurring amino acid
  misc_feature (14)..(14): Xaa can be any naturally occurring amino acid
  misc_feature (20)..(20): Xaa can be any naturally occurring amino acid
  misc_feature (23)..(23): Xaa can be any naturally occurring amino acid
  misc_feature (26)..(27): Xaa can be any naturally occurring amino acid
  misc_feature (33)..(33): Xaa can be any naturally occurring amino acid
  misc_feature (39)..(39): Xaa can be any naturally occurring amino acid
  misc_feature (43)..(43): Xaa can be any naturally occurring amino acid
  misc_feature (46)..(46): Xaa can be any naturally occurring amino acid
  misc_feature (51)..(52): Xaa can be any naturally occurring amino acid
  misc_feature (56)..(56): Xaa can be any naturally occurring amino acid
  misc_feature (58)..(58): Xaa can be any naturally occurring amino acid
  misc_feature (61)..(61): Xaa can be any naturally occurring amino acid
  misc_feature (68)..(68): Xaa can be any naturally occurring amino acid
  misc_feature (76)..(77): Xaa can be any naturally occurring amino acid
  misc_feature (79)..(79): Xaa can be any naturally occurring amino acid
  misc_feature (97)..(97): Xaa can be any naturally occurring amino acid
  misc_feature (109)..(109): Xaa can be any naturally occurring amino acid
LAGGFPEETSXPGXKKLTPXKVXPLXXQWPKGXCPGTPXSCGXPQXSKKGXXSFHXNXFKXGPKCSKXIRAQWKQXXMXFVTEFQSFIRLWQALLQXIFGPFRRRCQAXTFF

SEQ ID NO: 691 - protein, 93 aa, Homo sapiens
  misc_feature (15)..(15): Xaa can be any naturally occurring amino acid
  misc_feature (17)..(18): Xaa can be any naturally occurring amino acid
  misc_feature (26)..(26): Xaa can be any naturally occurring amino acid
  misc_feature (33)..(33): Xaa can be any naturally occurring amino acid
  misc_feature (36)..(36): Xaa can be any naturally occurring amino acid
  misc_feature (38)..(38): Xaa can be any naturally occurring amino acid
  misc_feature (42)..(43): Xaa can be any naturally occurring amino acid
  misc_feature (48)..(48): Xaa can be any naturally occurring amino acid
  misc_feature (51)..(51): Xaa can be any naturally occurring amino acid
  misc_feature (55)..(55): Xaa can be any naturally occurring amino acid
  misc_feature (61)..(61): Xaa can be any naturally occurring amino acid
  misc_feature (67)..(68): Xaa can be any naturally occurring amino acid
  misc_feature (71)..(71): Xaa can be any naturally occurring amino acid
  misc_feature (74)..(74): Xaa can be any naturally occurring amino acid
  misc_feature (80)..(80): Xaa can be any naturally occurring amino acid
  misc_feature (83)..(83): Xaa can be any naturally occurring amino acid
SLPQSDEALEFCYKXHXXLLPLGPNXFGTFGPXLEXIXMKTXXAFFTXLGXATTXGGSRAXALWPLXXKGXNFXGGEFFXARXTGFLRETPCQ

SEQ ID NO: 692 - protein, 194 aa, Homo sapiens
KKYLAHLEQLKEEELNPDFIEQVAEFCSYILSHSNVKTLSGLESLVLTYVNAISSGDLPCMENAVLALAQIENSAAVEKAIAHYEQQMGQKVQLPTETLQELLDLHRDSEREAIEVFMKNSFKDVDQMFQRKLGAQLEARRDDFCKQNSKASSDCCMALLQDIFGPLEEDVKQGTFSKPGGYRLFTQKLQGAEE

SEQ ID NO: 693 - protein, 130 aa, Homo sapiens
  misc_feature (5)..(5): Xaa can be any naturally occurring amino acid
  misc_feature (12)..(12): Xaa can be any naturally occurring amino acid
  misc_feature (19)..(20): Xaa can be any naturally occurring amino acid
  misc_feature (22)..(22): Xaa can be any naturally occurring amino acid
  misc_feature (29)..(29): Xaa can be any naturally occurring amino acid
  misc_feature (44)..(44): Xaa can be any naturally occurring amino acid
  misc_feature (47)..(47): Xaa can be any naturally occurring amino acid
  misc_feature (60)..(60): Xaa can be any naturally occurring amino acid
  misc_feature (70)..(71): Xaa can be any naturally occurring amino acid
PPGNXPEVVALXRASKKGXXSXNKDFFKXGPKCSREIRGPVEAXRNXFCSQIPKLIRLWXGFTSRIYWAXXKKMSSREHFLNPEGSGFFTQKLQELKNKSTRAKKGIQAKEVLKKYLESKEDVADALLQT

SEQ ID NO: 694 - protein, 89 aa, Homo sapiens
  misc_feature (19)..(21): Xaa can be any naturally occurring amino acid
  misc_feature (30)..(30): Xaa can be any naturally occurring amino acid
  misc_feature (44)..(44): Xaa can be any naturally occurring amino acid
  misc_feature (46)..(46): Xaa can be any naturally occurring amino acid
  misc_feature (62)..(62): Xaa can be any naturally occurring amino acid
  misc_feature (69)..(69): Xaa can be any naturally occurring amino acid
  misc_feature (71)..(72): Xaa can be any naturally occurring amino acid
  misc_feature (79)..(79): Xaa can be any naturally occurring amino acid
  misc_feature (86)..(86): Xaa can be any naturally occurring amino acid
VKKPEPSGLRKCSLLDIFXXXAQYILEVKXCHNLMSFGIWLQKXFXLASTGPLISLEHLGPXLKKSLLXLXXPFLLALXRATTSGXFPG

SEQ ID NO: 695 - protein, 203 aa, Homo sapiens
PKKYLAHLEQLKEEELNPDFIEQVAEFCSYILSHSNVKTLSGGIPVNGPRLESLVLTYVNAISSGDLPCMENAVLALAQIENSAAVEKAIAHYEQQMGQKVQLPTETLQELLDLHRDSEREAIEVFMKNSFKDVDQMFQRKLGAQLEARRDDFCKQNSKASSDCCMALLQDIFGPLEEDVKQGTFSKPGGYRLFTQKLAGAEE

SEQ ID NO: 696 - protein, 159 aa, Homo sapiens
  misc_feature (81)..(81): Xaa can be any naturally occurring amino acid
  misc_feature (133)..(133): Xaa can be any naturally occurring amino acid
  misc_feature (142)..(143): Xaa can be any naturally occurring amino acid
  misc_feature (152)..(152): Xaa can be any naturally occurring amino acid
GTINQQAMDQLHYVTELTDRIKANSSPGNNSVDDSADFVSFFPAFVWTLRDFTLELEVDGEPITADDYLELSLKLRKGTDXKSKSFNDPRLCIRKFFPKRKCFVFDWPAPKKYLAHLEQLKEEELNPDFIEQXAEFCSYILXXSNVKTLSGXIPAMGLV

SEQ ID NO: 697 - protein, 194 aa, Homo sapiens
YGQGINPISRLAQIQQAKKEKEPEYTLLTERGLPRRREFVMQVKVGNHTAEGTGTNKKVAKRNAAENMLEILGFKVPQAQPTKPALKSEEKTPIKKPGDGRKVTFFEPGSGDENGTSNKEDEFRMPYLSHQQLPAGILPMVPEVAQAVGVSQGHHTKDFTRAAPNPAKATVTAMIARELLYGGTSPTAETILKE

SEQ ID NO: 698 - protein, 92 aa, Homo sapiens
QYRALWKITLQVYMDYMEIISCSVVKAKSSRAICIDTQCFLIIFKTEIKVHLSPVCINKNKNEIKMEPNDHLKFKIPKLSNLYNCGRLIQGF

SEQ ID NO: 699 - protein, 395 aa, Homo sapiens
HKSDLPAFSAEVEEESEAGKESEETETKQTLKEFRCQVSDCSRIFQAITGLIQHYMKLHEMTPEEIESMTASVDVGKFPCDQLECKSSFTTYLNYVVHLEADHGIGLRASKTEEDGVYKCDCEGCDRIYATRSNLLRHIFNKHNDKHKAHLIRPRRLTPGQENMSSKANQEKSKSKHRGTKHSRCGKEGIKMPKTKRKKKNNLENKNAKIVQIEENKPYSLKRGKHVYSIKARNDALSECTSRFVTQYPCMIKGCTSVVTSESNIIRHYKCHKLSKAFTSQHRNLLIVFKRCCNSQVKETSEQEGAKNDVKDSDTCVSESNDNSRTTATVSQKEVEKNEKDEMDELTELFITKLINEDSTSVETQANTSSNVSNDFQGRYLCQSERQKASNLKKS

SEQ ID NO: 700 - protein, 209 aa, Homo sapiens
KEGIKMPKTKRKKKNNLENKNAKIVQIEENKPYSLKRGKHVYSIKARNDALSECTSRFVTQYPCMIKGCTSVVTSESNIIRHYKCHKLSKAFTSQHRNLLIVFKRCCNSQVKETSEQEGAKNDVKDSDTCVSESNDNSRTTATVSQKEVEKNEKDEMDELTELFITKLINEDSTSVETQANTSSNVSNDFQGRYLCQSERQKASNLKKS

SEQ ID NO: 701 - protein, 139 aa, Homo sapiens
  misc_feature (3)..(3): Xaa can be any naturally occurring amino acid
  misc_feature (7)..(7): Xaa can be any naturally occurring amino acid
  misc_feature (9)..(9): Xaa can be any naturally occurring amino acid
  misc_feature (20)..(20): Xaa can be any naturally occurring amino acid
  misc_feature (40)..(40): Xaa can be any naturally occurring amino acid
  misc_feature (44)..(44): Xaa can be any naturally occurring amino acid
  misc_feature (51)..(51): Xaa can be any naturally occurring amino acid
  misc_feature (78)..(78): Xaa can be any naturally occurring amino acid
  misc_feature (81)..(81): Xaa can be any naturally occurring amino acid
  misc_feature (109)..(109): Xaa can be any naturally occurring amino acid
FFXFVPXSXNQYFFFEFERXPFFCFPVFGRVFGRIFFWVXLQTXQKFQKRXFNSHWLKRAPVKEAECSSMVECQQQFXFLXGTLLNSAADAGSAFSTFLFLFCETFFSXINSSSNYWLFVFRTGRGIFPENHYLHLKKY

SEQ ID NO: 702 - protein, 135 aa, Homo sapiens
  misc_feature (3)..(3): Xaa can be any naturally occurring amino acid
  misc_feature (7)..(8): Xaa can be any naturally occurring amino acid
  misc_feature (20)..(20): Xaa can be any naturally occurring amino acid
  misc_feature (40)..(40): Xaa can be any naturally occurring amino acid
  misc_feature (44)..(44): Xaa can be any naturally occurring amino acid
  misc_feature (50)..(50): Xaa can be any naturally occurring amino acid
  misc_feature (77)..(77): Xaa can be any naturally occurring amino acid
  misc_feature (80)..(80): Xaa can be any naturally occurring amino acid
  misc_feature (108)..(108): Xaa can be any naturally occurring amino acid
FSXLSQXXLTNIFFLNLKGXPFFVSQYSEGFLAGFFFGFXCRLXKNFKKXTSIPIGLKELQSKKQNAPQWLNANSSXFFXTARYLTQLLMLVQLFQLSFFYFVRHFFXLLTLLQITGFLSFGLAEVSSLKIITYI

SEQ ID NO: 703 - protein, 135 aa, Homo sapiens
  misc_feature (28)..(28): Xaa can be any naturally occurring amino acid
  misc_feature (57)..(57): Xaa can be any naturally occurring amino acid
  misc_feature (64)..(64): Xaa can be any naturally occurring amino acid
  misc_feature (69)..(69): Xaa can be any naturally occurring amino acid
  misc_feature (76)..(76): Xaa can be any naturally occurring amino acid
  misc_feature (80)..(81): Xaa can be any naturally occurring amino acid
  misc_feature (86)..(86): Xaa can be any naturally occurring amino acid
  misc_feature (101)..(101): Xaa can be any naturally occurring amino acid
  misc_feature (103)..(104): Xaa can be any naturally occurring amino acid
  misc_feature (123)..(123): Xaa can be any naturally occurring amino acid
  misc_feature (126)..(126): Xaa can be any naturally occurring amino acid
FPLVTAVLSIFFLEFEWDPFLFPVFGWXLQYFSSASLQTPQETSEMIFKSHWLKKSXSQKDARXSSMGXMAPAVSXSLPXXLNSAXGCWVNLFQLFLFLFXEXXFSLLTLFKYLAFWLSDWAXGFXPENHSLHLK

SEQ ID NO: 704 - protein, 123 aa, Homo sapiens
  misc_feature (13)..(13): Xaa can be any naturally occurring amino acid
GVCSEAEEKYCKXHPNTGNKKGSHSNSRKNIDKTAVTSGNHVCPCKESETFVQFANPSQLQCSDNVKIVLDKNLKDCTELVLKQLQEMKPTVSLKKLEVHSNDPDMSVMKDISIGKATGRGQY

SEQ ID NO: 705 - protein, 242 aa, Homo sapiens
  misc_feature (175)..(175): Xaa can be any naturally occurring amino acid
  misc_feature (213)..(213): Xaa can be any naturally occurring amino acid
  misc_feature (226)..(227): Xaa can be any naturally occurring amino acid
  misc_feature (233)..(233): Xaa can be any naturally occurring amino acid
HEMTPEEIESMTASVDVGKFPCDQLECKSSFTTYLNYVVHLEADHGIGLRASKTEEDGVYKCDCEGCDRIYATRSNLLRHIFNKHNDKHKAHLIRPRRLTPGQENMSSKANQEKSKSKHRGTKHSRCGKEGIKMPKTKRKKKNNLENKNAKIVQIEENKPYSLKRGKHVYSIKAXNDALSECTSRFVTQYPCMIKGCTSVVTSESNIIRHYKXHKLSKALHHTPEXXLLFSNXVCTPSKGNV

SEQ ID NO: 706 - protein, 200 aa, Homo sapiens
  misc_feature (20)..(20): Xaa can be any naturally occurring amino acid
  misc_feature (23)..(23): Xaa can be any naturally occurring amino acid
  misc_feature (37)..(38): Xaa can be any naturally occurring amino acid
  misc_feature (82)..(82): Xaa can be any naturally occurring amino acid
  misc_feature (138)..(138): Xaa can be any naturally occurring amino acid
  misc_feature (165)..(165): Xaa can be any naturally occurring amino acid
  misc_feature (183)..(183): Xaa can be any naturally occurring amino acid
  misc_feature (199)..(199): Xaa can be any naturally occurring amino acid
HKSDLPAFSAEVEEESEAGXESXETETKQTLKEFRCXXSDCSRIFQAITGLIQHYMKLHEMTPEEIESMTASVDVGKFPCDXLECKSSFTTYLNYVVHLEADHGIGLRASKTEEDGVYKCDCEGCDRIYATRTNLLRXIFNKHNDKHKAHLIRPRRLTPGQENMXSKANQEKSKSKHRGTKHXKCGKEGIKMPRPTKEXK

SEQ ID NO: 707 - protein, 103 aa, Homo sapiens
  misc_feature (1)..(1): Xaa can be any naturally occurring amino acid
  misc_feature (6)..(6): Xaa can be any naturally occurring amino acid
  misc_feature (21)..(21): Xaa can be any naturally occurring amino acid
  misc_feature (27)..(27): Xaa can be any naturally occurring amino acid
  misc_feature (39)..(39): Xaa can be any naturally occurring amino acid
  misc_feature (54)..(54): Xaa can be any naturally occurring amino acid
  misc_feature (70)..(70): Xaa can be any naturally occurring amino acid
  misc_feature (89)..(89): Xaa can be any naturally occurring amino acid
XSYRNXGLQILLGHSDRASFXSLNRIXMLPTFQKIRLIXFQFAQSLHSCFLNYXFSFVGRGIFIPSFPHXLCLVPRCLDFDFSWFALLXIFSWPGVNLLGRIK

SEQ ID NO: 708 - protein, 135 aa, Homo sapiens
  misc_feature (22)..(22): Xaa can be any naturally occurring amino acid
  misc_feature (24)..(24): Xaa can be any naturally occurring amino acid
  misc_feature (40)..(40): Xaa can be any naturally occurring amino acid
  misc_feature (47)..(47): Xaa can be any naturally occurring amino acid
  misc_feature (52)..(52): Xaa can be any naturally occurring amino acid
  misc_feature (60)..(61): Xaa can be any naturally occurring amino acid
  misc_feature (64)..(64): Xaa can be any naturally occurring amino acid
  misc_feature (69)..(69): Xaa can be any naturally occurring amino acid
  misc_feature (71)..(71): Xaa can be any naturally occurring amino acid
  misc_feature (74)..(74): Xaa can be any naturally occurring amino acid
  misc_feature (84)..(85): Xaa can be any naturally occurring amino acid
  misc_feature (87)..(87): Xaa can be any naturally occurring amino acid
  misc_feature (89)..(89): Xaa can be any naturally occurring amino acid
  misc_feature (113)..(113): Xaa can be any naturally occurring amino acid
  misc_feature (115)..(115): Xaa can be any naturally occurring amino acid
  misc_feature (121)..(121): Xaa can be any naturally occurring amino acid
  misc_feature (123)..(123): Xaa can be any naturally occurring amino acid
  misc_feature (127)..(127): Xaa can be any naturally occurring amino acid
MGSFFVSSIRMVFAVFFFCFTXDXSRNFRNDLQIPLGLKXLQSKRCXDAPHXLNGNSKFXXLYXRYLTXLXMLXQLFQLSFFIXXDXFXFYLSSNTCFWLSDGRGFFRKHFFXLXKFNLGXSXGLSXLLIWKKQS

SEQ ID NO: 709 - protein, 67 aa, Homo sapiens
  misc_feature (16)..(16): Xaa can be any naturally occurring amino acid
  misc_feature (32)..(32): Xaa can be any naturally occurring amino acid
  misc_feature (37)..(37): Xaa can be any naturally occurring amino acid
SSKPIGLKELQSKDAXCSSMGEWHSSFFFFTXRYLTXLLMAGSTFSTFLFYLGRHFFLITLSKTAFG

SEQ ID NO: 710 - protein, 131 aa, Homo sapiens
  misc_feature (9)..(9): Xaa can be any naturally occurring amino acid
  misc_feature (18)..(19): Xaa can be any naturally occurring amino acid
  misc_feature (21)..(21): Xaa can be any naturally occurring amino acid
  misc_feature (79)..(79): Xaa can be any naturally occurring amino acid
  misc_feature (86)..(86): Xaa can be any naturally occurring amino acid
  misc_feature (99)..(99): Xaa can be any naturally occurring amino acid
RSFLKFLEXSAVKQKKNXXKXHPNTGNKKGSHSNSRKNIDKTAVTSGNHVCPCKESETFVQFANPSQLQCSDNVKIVLXKNLKDCXELVLKQLQEMKPXVSLKKLEVHSNDPDMSVMKDISIGKATGRGQY

SEQ ID NO: 711 - protein, 528 aa, Homo sapiens
  misc_feature (367)..(367): Xaa can be any naturally occurring amino acid
KNRSIGAAAKSQVISNAKNTVQGFKRFHGRAFSDPFVEAEKSNLAYDIVQLPTGLTGIKVTYMEEERNFTTEQVTAMLLSKLKETAESVLKKPVVDCVVSVPCFYTDAERRSVMDATQIAGLNCLRLMNETTAVALAYGIYKQDLPALEEKPRNVVFVDMGHSAYQVSVCAFNRGKLKVLATAFDTTLGGRKFDEVLVNHFCEEFGKKYKLDIKSKIRALLRLSQECEKLKKLMSANASDLPLSIECFMNDVDVSGTMNRGKFLEMCNDLLARVEPPLRSVLEQTKLKKEDIYAVEIVGGATRIPAVKEKISKFFGKELSTTLNADEAVTRGCALQCAILSPAFKVREFSITDVVPYPISLRWNSPXEEGSSDCEVFSKNHAAPFSKVLTFYRKEPFTLEAYYSSPQDLPYPDPAIAQFSVQKVTPQSDGSSSKVKVKVRVNVHGIFSVSSASLVEVHKSEENEEPMETDQNAKEEEKMQVDQEEPHVEEQQQQTPAENKAESEEMETSQAGSKDKKMDQPPKPRRQK

SEQ ID NO: 712 - protein, 156 aa, Homo sapiens
DCEVFSKNHAAPFSKVLTFYRKEPFTLEAYYSSPQDLPYPDPAIAQFSVQKVTPQSDGSSSKVKVKVRVNVHGIFSVSSASLVEVHKSEENEEPMETDQNAKEEEKMQVDQEEPHVEEQQQQTPAENKAESEEMETSQAGSKDKKMDQPPKPRRQK

SEQ ID NO: 713 - protein, 166 aa, Homo sapiens
  misc_feature (116)..(116): Xaa can be any naturally occurring amino acid
  misc_feature (119)..(120): Xaa can be any naturally occurring amino acid
  misc_feature (122)..(122): Xaa can be any naturally occurring amino acid
  misc_feature (124)..(124): Xaa can be any naturally occurring amino acid
  misc_feature (136)..(137): Xaa can be any naturally occurring amino acid
VNLLRYVSRNLKNDQKLFEELGKQIHQYMKIISSFKNKEDQYDHLDAADMTKVEKSTNEAMEWMNNKLNLQNKQSLTMDPVVKSKEIEAKIKELTSTCSPIISKPKPKVEPPKEGXKMXXRXAXWMDKETTQAPRXXSRVQTQLCLRIQTRSFLKWTLIDSNTCFY

SEQ ID NO: 714 - protein, 219 aa, Homo sapiens
VVSVPCFYTDAERRSVMDATQIAGLNCLRLMNETTAVALAYGIYKQDLPALEEKPRNVVFVDMGHSAYQVSVCAFNRGKLKVLATAFDTTLGGRKFDEVLVNHFCEEFGKKYKLDIKSKIRALLRLSQECEKLKKLMSANASDLPLSIECFMNDVDVSGTMNRGKFLEMCNDLLARVEPPLRSVLEQTKLKKEDIYAVEIVGGATRIPAVKEKISQIFR

SEQ ID NO: 715 - protein, 184 aa, Homo sapiens
KNRSIGAAAKSQVISNAKNTVQGFKRFHGRAFSDPFVEAEKSNLAYDIVQLPTGLTGIKVTYMEEERNFTTEQVTAMLLSKLKETAESVLKKPVVDCVVSVPCFYTDAERRSVMDATQIAGLNCLRLMNETTAVALAYGIYKQDLPALEEKPRNVVFVDMGHSAYQVSVCAFNRGKLKVSGHCI

SEQ ID NO: 716 - protein, 247 aa, Homo sapiens
  misc_feature (236)..(237): Xaa can be any naturally occurring amino acid
  misc_feature (240)..(240): Xaa can be any naturally occurring amino acid
FHGRAFSDPFVEAEKSNLAYDIVQLPTGLTGIKVTYMEEERNFTTEQVTAMLLSKLKETAESVLKKPVVDCVVSVPCFYTDAERRSVMDATQIAGFNCLRLMNETTAVALAYGIYKQDLPALEEKPRNVVFVDMGHSAYQVSVCAFNRGKLKVLATAFDTTLGGRKFDEVLVNHFCEEFGKKYKLDIKSKIRALLRLSQECEKLKKIDEVQMLQISLLSIEWFMNDVDVSWNYEIXXNFXEKVPMIS

SEQ ID NO: 717 - protein, 176 aa, Homo sapiens
  misc_feature (147)..(147): Xaa can be any naturally occurring amino acid
LRLSQECEKLKKLMSANASDLPLSIECFMNDVDVSGTMNRGKFLEMCNDLLARVEPPLRSVLEQTKLKKEDIYAVEIVGGATRIPAVKEKISKFFGKELSTTLNADEAVTRGCALQCAILSPAFKVREFSITDVVPYPISLRWNSPXEEGSSDCEVFFKNHAAPFSKVLTFYRKEP

SEQ ID NO: 718 - protein, 178 aa, Homo sapiens
EDAFKIWVIFNFLSEDKYPLIIVSEEIEYLLKKLTEAMGGGWQQEQFEHYKINFDDSKNGLSAWELIELIGNGQFSKGMDRQTVSMAINEVFNELILDVLKQGYMMKKGHRRKNWTERWFVLKPNIISYYVSEDLKDKKGDILLDENCCVESLPDKDGKKCLFLVKCFDKTFEISAFR

SEQ ID NO: 719 - protein, 107 aa, Homo sapiens
  misc_feature (107)..(107): Xaa can be any naturally occurring amino acid
FVLRWSLTLLPKLEYNGIISARCNLRLPRSSDSPASASQVAGITGARHQAQLIFFVFLVETGFHQVGQAGLELLTSGDPPASASQSAGITGVSHHARPPKLFLLSLX

SEQ ID NO: 720 - protein, 45 aa, Homo sapiens [sequence omitted]

SEQ ID NO: 721 - protein, 201 aa, Homo sapiens
  misc_feature (143)..(143): Xaa can be any naturally occurring amino acid
  misc_feature (181)..(181): Xaa can be any naturally occurring amino acid
EEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEXKMEEERNIIPREEKPIEDEIERKENIKPSLGSKKNLLXSIPTHSDQEKEVNIKKTRRQ

SEQ ID NO: 722 - protein, 205 aa, Homo sapiens
  misc_feature (5)..(5): Xaa can be any naturally occurring amino acid
  misc_feature (12)..(12): Xaa can be any naturally occurring amino acid
  misc_feature (15)..(15): Xaa can be any naturally occurring amino acid
  misc_feature (18)..(18): Xaa can be any naturally occurring amino acid
  misc_feature (27)..(27): Xaa can be any naturally occurring amino acid
  misc_feature (36)..(36): Xaa can be any naturally occurring amino acid
  misc_feature (48)..(49): Xaa can be any naturally occurring amino acid
  misc_feature (99)..(99): Xaa can be any naturally occurring amino acid
KPLKXFFQILIXGCXFPXASCPKGGGXEESLQTVVXEESCSPSVELEXXPPVNVDSKPIEEKPVEVNAEKQNFQVVAVIQCLNTPPTTPESPSSVTVTXGSRQQSSVTVSEPLAPNQEEVRSIKSETDSTIEVDSVAGELQDLQSEGNSSPAGFDASVSSSSSNQPEPEHPEKACTGQKRVKDAQGGGSSSKKQKRSHKATVVNN

SEQ ID NO: 723 - protein, 228 aa, Homo sapiens
  misc_feature (225)..(225): Xaa can be any naturally occurring amino acid
INKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHSDQEKEVNIKKPEDNENLDDKDDDTTRVDESLNIKVEAEEEKAKSGDETNKEEDEDDEEAEEEEEEEEXRRG

SEQ ID NO: 724 - protein, 109 aa, Homo sapiens
  misc_feature (4)..(4): Xaa can be any naturally occurring amino acid
  misc_feature (14)..(14): Xaa can be any naturally occurring amino acid
  misc_feature (16)..(16): Xaa can be any naturally occurring amino acid
  misc_feature (20)..(21): Xaa can be any naturally occurring amino acid
  misc_feature (29)..(29): Xaa can be any naturally occurring amino acid
  misc_feature (44)..(44): Xaa can be any naturally occurring amino acid
TSFXHFLNFSLGPXRXLDFXXLVDSTQTXLPPLVGHHHLHPLLXSSSSSSSSASSSSSSSSLFVSSPDFAFSSSASTFMLRDSSTLVVSSSLSSRFSLSSGFLMLTSFS

SEQ ID NO: 725 - protein, 121 aa, Homo sapiens
  misc_feature (3)..(3): Xaa can be any naturally occurring amino acid
  misc_feature (37)..(38): Xaa can be any naturally occurring amino acid
  misc_feature (45)..(45): Xaa can be any naturally occurring amino acid
  misc_feature (54)..(54): Xaa can be any naturally occurring amino acid
  misc_feature (68)..(68): Xaa can be any naturally occurring amino acid
  misc_feature (71)..(71): Xaa can be any naturally occurring amino acid
  misc_feature (83)..(83): Xaa can be any naturally occurring amino acid
  misc_feature (91)..(91): Xaa can be any naturally occurring amino acid
  misc_feature (106)..(106): Xaa can be any naturally occurring amino acid
  misc_feature (108)..(108): Xaa can be any naturally occurring amino acid
  misc_feature (114)..(115): Xaa can be any naturally occurring amino acid
  misc_feature (119)..(120): Xaa can be any naturally occurring amino acid
DIXIFNTSFIHFLIFPSSIPHLDFHAWGIALKLLFLXXGIIIFIXFFFFLLLLXFCFFIIFIFFFIRXISXFCFFFLSFYLYXEGFIYPSXVIIFGAQIFIGFWFXNXNFFFLXXMGRXXF

SEQ ID NO: 726 - protein, 164 aa, Homo sapiens
  misc_feature (1)..(1): Xaa can be any naturally occurring amino acid
  misc_feature (3)..(3): Xaa can be any naturally occurring amino acid
  misc_feature (8)..(8): Xaa can be any naturally occurring amino acid
  misc_feature (11)..(11): Xaa can be any naturally occurring amino acid
  misc_feature (13)..(13): Xaa can be any naturally occurring amino acid
  misc_feature (15)..(16): Xaa can be any naturally occurring amino acid
  misc_feature (35)..(36): Xaa can be any naturally occurring amino acid
  misc_feature (45)..(46): Xaa can be any naturally occurring amino acid
  misc_feature (50)..(51): Xaa can be any naturally occurring amino acid
  misc_feature (57)..(57): Xaa can be any naturally occurring amino acid
  misc_feature (59)..(59): Xaa can be any naturally occurring amino acid
  misc_feature (74)..(74): Xaa can be any naturally occurring amino acid
  misc_feature (82)..(82): Xaa can be any naturally occurring amino acid
  misc_feature (94)..(94): Xaa can be any naturally occurring amino acid
  misc_feature (97)..(97): Xaa can be any naturally occurring amino acid
  misc_feature (111)..(111): Xaa can be any naturally occurring amino acid
  misc_feature (120)..(120): Xaa can be any naturally occurring amino acid
  misc_feature (127)..(128): Xaa can be any naturally occurring amino acid
  misc_feature (162)..(162): Xaa can be any naturally occurring amino acid
XGXKEIKXEEXGXIXXREEKPIEDEIERKENIKPXXGSKKNLLEXXPTHXXQEKEVXIXKPEANENLGAKDDDXTRVDESLXIKVEAEEEKAKXGDXTNKEEDEDDEEAEXEEEEEEEEXDEDDDAXXEEEEFECYPPGMKVQVRYGRGKNQKMYEASIKDXDV

SEQ ID NO: 727 - protein, 207 aa, Homo sapiens
WFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEGVL

SEQ ID NO: 728 - protein, 221 aa, Homo sapiens
  misc_feature (197)..(197): Xaa can be any naturally occurring amino acid
MLFAPCCHQCGEFIIGRVIKAMNNSWHPECFRCDLCQEVLADIGFVKNAGRHLCRPCHNREKARGLGKYICQKCHAIIDEQPLIFKNDPYHPDHFNCANCGKELTADARELKGELYCLPCHDKMGVPICGACRRPIEGRVVNAMGKQWHVEHFVCAKCEKPFLGHRHYERKGLAYCETHYNQLFGDVCFHCNRVIEXDVVSALNKAWCVNCFACSTLQHLN

SEQ ID NO: 729 - protein, 114 aa, Homo sapiens
LPFQLPCIGSQLLPAVGAVEMVWMVGVVLEYQRLLIDDSMAFLADVFPKASGFLTIMTGATQVSPSILDKPDICQNFLAEVTAEALRMPAVIHGFDNSANDEFTTLMTARGKEH

SEQ ID NO: 730 - protein, 191 aa, Homo sapiens; identical to SEQ ID NO: 632
  misc_feature (10)..(10): Xaa can be any naturally occurring amino acid
  misc_feature (12)..(12): Xaa can be any naturally occurring amino acid
  misc_feature (24)..(24): Xaa can be any naturally occurring amino acid
  misc_feature (80)..(80): Xaa can be any naturally occurring amino acid
  misc_feature (102)..(102): Xaa can be any naturally occurring amino acid
  misc_feature (125)..(125): Xaa can be any naturally occurring amino acid

SEQ ID NO: 731 - protein, 115 aa, Homo sapiens
  misc_feature (10)..(10): Xaa can be any naturally occurring amino acid
  misc_feature (12)..(12): Xaa can be any naturally occurring amino acid
  misc_feature (23)..(23): Xaa can be any naturally occurring amino acid
  misc_feature (80)..(80): Xaa can be any naturally occurring amino acid
  misc_feature (102)..(102): Xaa can be any naturally occurring amino acid
DGPLLASVTXSXPRLAAWRRRGXGSPKARASSYQAYVKPFVPRFAGLNVAWLESSEACVFPSSAATYYPFVQEPPVTEMXTQCLAPSIFITNPVVTEVFKQXSIEMRTHALSHKK

SEQ ID NO: 732 - protein, 139 aa, Homo sapiens
  misc_feature (131)..(131): Xaa can be any naturally occurring amino acid
  misc_feature (136)..(136): Xaa can be any naturally occurring amino acid
SISRFNSYTNYIVMKNRRKSPKVFFRPPLLTQNTDTQARTLINSNSSFERLKPPRILLAPGYIHCMLPDVFSRFQCSVALLFLSGLGGHLLQGSWGPVWVGWEVPEAWALPPAPAAHSPAWLDWIFLVHTXLETDXFFE

SEQ ID NO: 733 - protein, 155 aa, Homo sapiens
  misc_feature (7)..(7): Xaa can be any naturally occurring amino acid
  misc_feature (16)..(16): Xaa can be any naturally occurring amino acid
  misc_feature (23)..(23): Xaa can be any naturally occurring amino acid
  misc_feature (40)..(40): Xaa can be any naturally occurring amino acid
  misc_feature (61)..(61): Xaa can be any naturally occurring amino acid
  misc_feature (66)..(66): Xaa can be any naturally occurring amino acid
GQSLKKXPGPRAPKEXRGLPPLXPITPPFPKIHQPQIQGXLQPDALVKKVDACVTDPTQRXGPFPXPYVPERSSQAMLENVQQELVGEPRPQAPPSLPTQGPSCPAEDGPPALKEKEEPHYIEIWKKHLEAYSGCTLELEESLEASTSQMMNLNL

SEQ ID NO: 734 - protein, 126 aa, Homo sapiens
GEAGHWAGRISRYLDLYRWPGLIVHGRLLGCSECKGSLSKPFSLVLSGVRLFPFSFTSRSSSEESTGEVVLASRSSCSCWARYWAGFCLASLAQWRSSRCSRGKLAFKNGMTKGLSGKLVASCSLE

SEQ ID NO: 735 - protein, 105 aa, Homo sapiens
  misc_feature (62)..(62): Xaa can be any naturally occurring amino acid
  misc_feature (88)..(88): Xaa can be any naturally occurring amino acid
  misc_feature (92)..(92): Xaa can be any naturally occurring amino acid
TKTGRGELQTEPKKMALTESLCTQNIQASDHALLAQASGTSPNNGLSYQPNGLPHPTPPPPXHYRLDDMAIAHHYRDSYRHPSHRGPXGQKXTYGVAWHTSRRND

SEQ ID NO: 736 - protein, 124 aa, Homo sapiens; identical to SEQ ID NO: 634

SEQ ID NO: 737 - protein, 149 aa, Homo sapiens; identical to SEQ ID NO: 633
  misc_feature (12)..(12): Xaa can be any naturally occurring amino acid
  misc_feature (20)..(20): Xaa can be any naturally occurring amino acid
  misc_feature (26)..(26): Xaa can be any naturally occurring amino acid
  misc_feature (28)..(28): Xaa can be any naturally occurring amino acid
  misc_feature (31)..(31): Xaa can be any naturally occurring amino acid
  misc_feature (35)..(35): Xaa can be any naturally occurring amino acid
  misc_feature (44)..(44): Xaa can be any naturally occurring amino acid
  misc_feature (51)..(53): Xaa can be any naturally occurring amino acid
  misc_feature (59)..(60): Xaa can be any naturally occurring amino acid
  misc_feature (72)..(72): Xaa can be any naturally occurring amino acid
  misc_feature (84)..(84): Xaa can be any naturally occurring amino acid
  misc_feature (86)..(86): Xaa can be any naturally occurring amino acid
  misc_feature (90)..(90): Xaa can be any naturally occurring amino acid
  misc_feature (99)..(99): Xaa can be any naturally occurring amino acid
  misc_feature (103)..(103): Xaa can be any naturally occurring amino acid
  misc_feature (109)..(109): Xaa can be any naturally occurring amino acid
  misc_feature (115)..(115): Xaa can be any naturally occurring amino acid
  misc_feature (120)..(120): Xaa can be any naturally occurring amino acid
  misc_feature (122)..(122): Xaa can be any naturally occurring amino acid
  misc_feature (124)..(126): Xaa can be any naturally occurring amino acid
  misc_feature (129)..(129): Xaa can be any naturally occurring amino acid
  misc_feature (141)..(141): Xaa can be any naturally occurring amino acid
  misc_feature (149)..(149): Xaa can be any naturally occurring amino acid

SEQ ID NO: 738 - protein, 202 aa, Homo sapiens
VNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWGRRVETS

SEQ ID NO: 739 - protein, 70 aa, Homo sapiens
  misc_feature (50)..(50): Xaa can be any naturally occurring amino acid
  misc_feature (60)..(60): Xaa can be any naturally occurring amino acid
  misc_feature (64)..(64): Xaa can be any naturally occurring amino acid
RGVVSMVEGVPGVVDLGVAAGGVSIGLPAPLLGVTKELTAGVSPCCWACXVCPQMWMGLXPSFXAGQMSP

SEQ ID NO: 740 - protein, 105 aa, Homo sapiens
  misc_feature (7)..(7): Xaa can be any naturally occurring amino acid
  misc_feature (11)..(11): Xaa can be any naturally occurring amino acid
  misc_feature (21)..(21): Xaa can be any naturally occurring amino acid
WAHLPSXKAGXKPHPHLWTDXAGPAAGRHPCSQLFCHAQQRGWEPDGHTTSSHSEVNHPGNPFHHRDNPSLDVNSELSEERQHNQRETNSSSSDAQSCFFCLFVY

SEQ ID NO: 741 - protein, 267 aa, Homo sapiens
MMLPVLTHHIRYHQCLMHLDKLIGYTFQDRCLLQLAMTHPSHHLNFGMNPDHARNSLSNCGIRQPKYGDRKVHHMHMRKKGINTLINIMSRLGQDDPTPSRINHNERLEFLGDAVVEFLTSVHLYYLFPSLEEGGLATYRTAIVQNQHLAMLAKKLELDRFMLYAHGPDLCRESDLRHAMANCFEALIGAVYLEGSLEEAKQLFGRLLFNDPDLREVWLNYPLHPLQLQEPNTDRQLIGNFFQFYKKLTEFERNQLGVNFLLIGSDF

SEQ ID NO: 742 - protein, 143 aa, Homo sapiens
  misc_feature (15)..(15): Xaa can be any naturally occurring amino acid
  misc_feature (32)..(34): Xaa can be any naturally occurring amino acid
  misc_feature (44)..(44): Xaa can be any naturally occurring amino acid
  misc_feature (50)..(50): Xaa can be any naturally occurring amino acid
  misc_feature (63)..(63): Xaa can be any naturally occurring amino acid
NPGPRYGRTWASRSXPIPTPSQKALGVSPQAXXXLLESFIAALXIDKDLXYVHTFHECLFLSXIKRVHFESGLECPKSQLQQCCLPLGRRKRARHSFVQDSADSGPIPCPNLHCGCLFQGRKNRLWERTKYSASGNGSSNGCA

SEQ ID NO: 743 - protein, 87 aa, Homo sapiens
  misc_feature (16)..(16): Xaa can be any naturally occurring amino acid
  misc_feature (32)..(32): Xaa can be any naturally occurring amino acid
  misc_feature (34)..(35): Xaa can be any naturally occurring amino acid
  misc_feature (45)..(45): Xaa can be any naturally occurring amino acid
  misc_feature (50)..(50): Xaa can be any naturally occurring amino acid
  misc_feature (63)..(63): Xaa can be any naturally occurring amino acid
KTQAQGTEELGHPGVXQYPRQAKRPWGFRPKXWXXFWNHLLQRCXLIRIXNMFILFMNVCFFXRLKEFILNQDWNAPNPSFSSVACP

SEQ ID NO: 744 - protein, 101 aa, Homo sapiens [sequence omitted]

SEQ ID NO: 745 - protein, 277 aa, Homo sapiens
INTLINIMSRLGQDDPTPSRINHNERLEFLGDAVVEFLTSVHLYYLFPSLEEGGLATYRTAIVQNQHLAMLAKKLELDRFMLYAHGPDLCRESDLRHAMANCFEALIGAVYLEGSLEEAKQLFGRLLFNDPDLREVWLNYPLHPLQLQEPNTDRQLIETSPVLQKLTEFEEAIGVIFTHVRLLARAFTLRTVGFNHLTLGHNQRMEFLGDSIMQLVPQSTYSFISQIIIEGHLTFVAKASLGEINKNFRPKGNRKEAWALQGSTPITQPDQEPKKAC

SEQ ID NO: 746 - protein, 187 aa, Homo sapiens; identical to SEQ ID NO: 635
  misc_feature (12)..(18): Xaa can be any naturally occurring amino acid
  misc_feature (20)..(20): Xaa can be any naturally occurring amino acid
  misc_feature (97)..(97): Xaa can be any naturally occurring amino acid
  misc_feature (113)..(113): Xaa can be any naturally occurring amino acid
  misc_feature (169)..(169): Xaa can be any naturally occurring amino acid
  misc_feature (176)..(176): Xaa can be any naturally occurring amino acid
  misc_feature (181)..(182): Xaa can be any naturally occurring amino acid
  misc_feature (187)..(187): Xaa can be any naturally occurring amino acid

SEQ ID NO: 747 - protein, 89 aa, Homo sapiens
  misc_feature (20)..(20): Xaa can be any naturally occurring amino acid
  misc_feature (25)..(25): Xaa can be any naturally occurring amino acid
  misc_feature (45)..(46): Xaa can be any naturally occurring amino acid
  misc_feature (63)..(63): Xaa can be any naturally occurring amino acid
  misc_feature (69)..(69): Xaa can be any naturally occurring amino acid
  misc_feature (77)..(78): Xaa can be any naturally occurring amino acid
IDPPPFPFKHFPLPFSGEAXPSKVXRSCFFFNPTCSFGFAYLTLXXSPQPLGILGEFGLGWAXPKTNGXKCETASCXXPFLPIRTSFKL

SEQ ID NO: 748 - protein, 71 aa, Homo sapiens
  misc_feature (1)..(1): Xaa can be any naturally occurring amino acid
  misc_feature (3)..(3): Xaa can be any naturally occurring amino acid
  misc_feature (17)..(17): Xaa can be any naturally occurring amino acid
  misc_feature (35)..(35): Xaa can be any naturally occurring amino acid
  misc_feature (44)..(44): Xaa can be any naturally occurring amino acid
  misc_feature (50)..(50): Xaa can be any naturally occurring amino acid
  misc_feature (67)..(68): Xaa can be any naturally occurring amino acid
XLXSMNKRMGSYTFIAXFKKDAYNLKDVLMGRKGXGQEAVSHFXPLVFGXAQPRPNSPRMPNGCGDXXRVK

SEQ ID NO: 749 - protein, 254 aa, Homo sapiens
  misc_feature (185)..(185): Xaa can be any naturally occurring amino acid
  misc_feature (193)..(193): Xaa can be any naturally occurring amino acid
  misc_feature (213)..(213): Xaa can be any naturally occurring amino acid
  misc_feature (217)..(217): Xaa can be any naturally occurring amino acid
  misc_feature (220)..(220): Xaa can be any naturally occurring amino acid
  misc_feature (222)..(222): Xaa can be any naturally occurring amino acid
  misc_feature (224)..(224): Xaa can be any naturally occurring amino acid
  misc_feature (229)..(229): Xaa can be any naturally occurring amino acid
  misc_feature (235)..(235): Xaa can be any naturally occurring amino acid
  misc_feature (249)..(249): Xaa can be any naturally occurring amino acid
VCKGILEYLTVAEVVETMEDLVTYTKNLGPGMTKMAKMIDERQQELTHQEHRVMLVNSMNTVKELLPVLISAMKIFVTTKNSKNQGIEEALKNRNFTVEKMSAEINEIIRVLQLTSWDEDAWASKDTEAMKRALASIDSKLNQAKGWLRDPSASPGDAGEQAIRQILDEAGKVGELCAGKKRREXLGNLQNAXADDCQSGLTSVPRGQGSLPXGPCXKSXTXYXQGLGXCSPAKXEKASFQSWESLAHXKPKHL

SEQ ID NO: 750 - protein, 82 aa, Homo sapiens
LFSRPSAYLYSCLPDINAILMPLKYESMPKITCCFTKERLLRGNKKNHVCSPGSSSGLRHWFTLYAGCAFLQYQCSRHSEAN

SEQ ID NO: 751 - protein, 162 aa, Homo sapiens; identical to SEQ ID NO: 637

SEQ ID NO: 752 - protein, 120 aa, Homo sapiens
ASISESLKNLSSTMDFSLGFPCPLFCTLLCCSNLLISKSRSESSSLKTGLFLRSDLLEFSALSPISGSSLPMSDTSSSSKSSRSSLSSASISEPSSSRSCSSLSGRRLISSSLIVSLTAF

SEQ ID NO: 753 - protein, 143 aa, Homo sapiens
  misc_feature (1)..(1): Xaa can be any naturally occurring amino acid
  misc_feature (5)..(5): Xaa can be any naturally occurring amino acid
  misc_feature (9)..(9): Xaa can be any naturally occurring amino acid
  misc_feature (14)..(14): Xaa can be any naturally occurring amino acid
  misc_feature (16)..(16): Xaa can be any naturally occurring amino acid
  misc_feature (18)..(18): Xaa can be any naturally occurring amino acid
  misc_feature (20)..(20): Xaa can be any naturally occurring amino acid
  misc_feature (24)..(24): Xaa can be any naturally occurring amino acid
  misc_feature (27)..(27): Xaa can be any naturally occurring amino acid
  misc_feature (31)..(31): Xaa can be any naturally occurring amino acid
  misc_feature (33)..(38): Xaa can be any naturally occurring amino acid
  misc_feature (42)..(44): Xaa can be any naturally occurring amino acid
  misc_feature (47)..(48): Xaa can be any naturally occurring amino acid
  misc_feature (52)..(52): Xaa can be any naturally occurring amino acid
  misc_feature (58)..(61): Xaa can be any naturally occurring amino acid
  misc_feature (65)..(65): Xaa can be any naturally occurring amino acid
  misc_feature (67)..(69): Xaa can be any naturally occurring amino acid
  misc_feature (73)..(73): Xaa can be any naturally occurring amino acid
  misc_feature (77)..(77): Xaa can be any naturally occurring amino acid
  misc_feature (79)..(83): Xaa can be any naturally occurring amino acid
  misc_feature (85)..(85): Xaa can be any naturally occurring amino acid
  misc_feature (87)..(87): Xaa can be any naturally occurring amino acid
  misc_feature (95)..(97): Xaa can be any naturally occurring amino acid
  misc_feature (99)..(99): Xaa can be any naturally occurring amino acid
  misc_feature (104)..(105): Xaa can be any naturally occurring amino acid
  misc_feature (107)..(107): Xaa can be any naturally occurring amino acid
  misc_feature (112)..(112): Xaa can be any naturally occurring amino acid
  misc_feature (119)..(121): Xaa can be any naturally occurring amino acid
  misc_feature (124)..(125): Xaa can be any naturally occurring amino acid
  misc_feature (131)..(131): Xaa can be any naturally occurring amino acid
  misc_feature (142)..(142): Xaa can be any naturally occurring amino acid
XACPXIKVXSNFPXIXMXEXAPVXVSXAAFXAXXXXXXKNKXXXIKXXAEKXAPAKNXXXXKKKXQXXXKIKXKEKXRXXXXXTXVXQAGKSSKXXXWXKLKQXXKXGKASXIKDEGKXXXLKXXQAFFFXFQDQVKMQINXA

SEQ ID NO: 754 - protein, 66 aa, Homo sapiens
NQRHLEKHMIDFFASRMPETLHLPHGTMRQSPNPMSALERYSYYYSCKTINQLIHICTAGSPRDKI

SEQ ID NO: 755 - protein, 69 aa, Homo sapiens [sequence omitted]

SEQ ID NO: 756 - protein, 91 aa, Homo sapiens
WFCNCNSSCIVLMQTLDLVTVSLCHEVNVMFQAFCLQKNLSCAFLDVSGSIVQMLLLANRNFKITWNLHKRLFMCLTFLKRSLLYSLEYVT

SEQ ID NO: 757 - protein, 63 aa, Homo sapiens
  misc_feature (4)..(4): Xaa can be any naturally occurring amino acid
  misc_feature (8)..(8): Xaa can be any naturally occurring amino acid
  misc_feature (12)..(12): Xaa can be any naturally occurring amino acid
  misc_feature (14)..(15): Xaa can be any naturally occurring amino acid
  misc_feature (17)..(18): Xaa can be any naturally occurring amino acid
  misc_feature (20)..(20): Xaa can be any naturally occurring amino acid
  misc_feature (22)..(22): Xaa can be any naturally occurring amino acid
  misc_feature (28)..(28): Xaa can be any naturally occurring amino acid
  misc_feature (43)..(43): Xaa can be any naturally occurring amino acid
  misc_feature (48)..(48): Xaa can be any naturally occurring amino acid
  misc_feature (51)..(51): Xaa can be any naturally occurring amino acid
  misc_feature (58)..(59): Xaa can be any naturally occurring amino acid
NSYXLIKXFALXNXXHXXKXMXDFFASXMPETLHLPYGTMRQXPNPMXALXRYSYFYXXETIN

SEQ ID NO: 758 - protein, 62 aa, Homo sapiens
  misc_feature (3)..(3): Xaa can be any naturally occurring amino acid
  misc_feature (8)..(8): Xaa can be any naturally occurring amino acid
  misc_feature (10)..(10): Xaa can be any naturally occurring amino acid
  misc_feature (18)..(18): Xaa can be any naturally occurring amino acid
  misc_feature (24)..(24): Xaa can be any naturally occurring amino acid
  misc_feature (27)..(27): Xaa can be any naturally occurring amino acid
  misc_feature (31)..(31): Xaa can be any naturally occurring amino acid
  misc_feature (39)..(39): Xaa can be any naturally occurring amino acid
  misc_feature (42)..(42): Xaa can be any naturally occurring amino acid
  misc_feature (46)..(46): Xaa can be any naturally occurring amino acid
  misc_feature (53)..(53): Xaa can be any naturally occurring amino acid
  misc_feature (55)..(55): Xaa can be any naturally occurring amino acid
  misc_feature (60)..(60): Xaa can be any naturally occurring amino acid
DSXQIQCXHXNDTATFTXAKPLIXLSXYVQXGPHVTKSXAEXFGSXNVDPAGXRXSKLLXPF

SEQ ID NO: 759 - protein, 68 aa, Homo sapiens
  misc_feature (2)..(2): Xaa can be any naturally occurring amino acid
  misc_feature (11)..(11): Xaa can be any naturally occurring amino acid
  misc_feature (26)..(26): Xaa can be any naturally occurring amino acid
  misc_feature (32)..(32): Xaa can be any naturally occurring amino acid
  misc_feature (42)..(42): Xaa can be any naturally occurring amino acid
  misc_feature (47)..(47): Xaa can be any naturally occurring amino acid
  misc_feature (51)..(53): Xaa can be any naturally occurring amino acid
  misc_feature (55)..(56): Xaa can be any naturally occurring amino acid
  misc_feature (58)..(58): Xaa can be any naturally occurring amino acid
  misc_feature (61)..(61): Xaa can be any naturally occurring amino acid
  misc_feature (66)..(66): Xaa can be any naturally occurring amino acid
TXNIPFIAYVXYSNEYNKLLFKKVRXMKSLLXKFHVILKFLXANKSXCTIXXXTXXKXHDXFFCKXNA

SEQ ID NO: 760 - protein, 91 aa, Homo sapiens
  misc_feature (4)..(4): Xaa can be any naturally occurring amino acid
  misc_feature (12)..(12): Xaa can be any naturally occurring amino acid
  misc_feature (14)..(14): Xaa can be any naturally occurring amino acid
  misc_feature (19)..(19): Xaa can be any naturally occurring amino acid
  misc_feature (34)..(34): Xaa can be any naturally occurring amino acid
  misc_feature (40)..(40): Xaa can be any naturally occurring amino acid
  misc_feature (42)..(42): Xaa can be any naturally occurring amino acid
  misc_feature (45)..(48): Xaa can be any naturally occurring amino acid
  misc_feature (50)..(50): Xaa can be any naturally occurring amino acid
  misc_feature (54)..(54): Xaa can be any naturally occurring amino acid
  misc_feature (59)..(59): Xaa can be any naturally occurring amino acid
  misc_feature (69)..(69): Xaa can be any naturally occurring amino acid
  misc_feature (75)..(75): Xaa can be any naturally occurring amino acid
  misc_feature (90)..(90): Xaa can be any naturally occurring amino acid
WFRXCKSSCIVXMXTLDLXTVSLCHKVNVMFQAXCLQKNXSXAFXXXXGXIVQXLLLAXRNFKITWNLXKRLFMXLTFLKRSLLYSLEYXT

SEQ ID NO: 761 - protein, 46 aa, Homo sapiens
HFSLLMPLGLGRRKKAPPLVENEEAEPGRGGLGVGEPGPLGGGGSG

SEQ ID NO: 762 - protein, 46 aa, Homo sapiens
PDPPPPRGPGSPTPSPPRPGSASSFSTRGGAFFRRPSPSGMSSEKW

SEQ ID NO: 763 - protein, 181 aa, Homo sapiens
  misc_feature (7)..(7): Xaa can be any naturally occurring amino acid
  misc_feature (88)..(88): Xaa can be any naturally occurring amino acid
  misc_feature (123)..(123): Xaa can be any naturally occurring amino acid
  misc_feature (132)..(132): Xaa can be any naturally occurring amino acid
AAQGQWXGGGPGPLPRSNGTIPSLVPSLAGVPGPPVPCSPPTSVGSGTGRGGISQIGGPPPPPPLSTISCQTGPSVSLGPWVLFGGHXLPSFLTQGIQGRGLSFPPANAIMPSPLLRGAPSLXSLLPPHLTXVCCEPRNLLPTSNFSFQAHPWPRAGGREGRWRWVFVSEFAVLNIKNQSA

SEQ ID NO: 764 - protein, 107 aa, Homo sapiens
  misc_feature (80)..(80): Xaa can be any naturally occurring amino acid
  misc_feature (87)..(87): Xaa can be any naturally occurring amino acid
  misc_feature (94)..(94): Xaa can be any naturally occurring amino acid
  misc_feature (97)..(99): Xaa can be any naturally occurring amino acid
PPNRTQGPRETEGPVWQLMVESGGGGGGPPIWLIPPLPVPDPTEVGGEQGTGGPGTPARLGTREGMVPLERGKGPGPPPXHCPWAAXLAQLEAXVLXXXPCWGPPQV

SEQ ID NO: 765 - protein, 114 aa, Homo sapiens
  misc_feature (10)..(11): Xaa can be any naturally occurring amino acid
  misc_feature (14)..(14): Xaa can be any naturally occurring amino acid
  misc_feature (21)..(21): Xaa can be any naturally occurring amino acid
  misc_feature (28)..(28): Xaa can be any naturally occurring amino acid
  misc_feature (110)..(110): Xaa can be any naturally occurring amino acid
APGGAPSRDXXSGXEPPAELXKQPKDNXREVGQAPCPAPMGPSPPWFPVWPGSPAPLCPVPHLPQLGQAQGGEGSAKLGGHPRLHHFPPSAAKLVPLSPWGLGFCLGVMXFLVS

SEQ ID NO: 766 - protein, 129 aa, Homo sapiens
SSSNLRLSFLINENILGKCFRSGPSCAGPRISPLAAQYECPRPSLLIMASVPKTNKIEPRSYSIIPSCGIQAARACFEHSNFFKVNASGPAGHSAKSIEGAPRGKGRGRAVARLAADRPPAPKIQLRAF

SEQ ID NO: 767 - protein, 157 aa, Homo sapiens
  misc_feature (12)..(12): Xaa can be any naturally occurring amino acid
  misc_feature (57)..(57): Xaa can be any naturally occurring amino acid
  misc_feature (59)..(59): Xaa can be any naturally occurring amino acid
KMAAGFKTVEPXEYYRRFLKENCRPDGRELGEFRTTTVNIGSISTADGSALVKLGNXTXICGVKAEFAAPSTDAPDKGYVVPNVDLPPLCSSRFRSGPPGEEAQVASQFIADVIENSQIIQKEDLCISPGKLVWVLYCDLICLDYDGNILDACTFAL

SEQ ID NO: 768 - protein, 171 aa, Homo sapiens; identical to SEQ ID NO: 638
  misc_feature (12)..(12): Xaa can be any naturally occurring amino acid
  misc_feature (57)..(57): Xaa can be any naturally occurring amino acid
  misc_feature (59)..(59): Xaa can be any naturally occurring amino acid
  misc_feature (156)..(156): Xaa can be any naturally occurring amino acid

SEQ ID NO: 769 - protein, 112 aa, Homo sapiens
  misc_feature (69)..(69): Xaa can be any naturally occurring amino acid
  misc_feature (72)..(72): Xaa can be any naturally occurring amino acid
QLPEVTINEETALAEVNLKKKSYLNIRTHPVATSFAVFDDTLLIVDPTGEEEHLATGTLTIVMDEEGKXCCXHKPGGSGLTGAKLQDCMSRAVTRHKEVKKLMDEVIKSMKP

SEQ ID NO: 770 - protein, 87 aa, Homo sapiens
  misc_feature (10)..(10): Xaa can be any naturally occurring amino acid
  misc_feature (19)..(19): Xaa can be any naturally occurring amino acid
  misc_feature (27)..(27): Xaa can be any naturally occurring amino acid
  misc_feature (35)..(38): Xaa can be any naturally occurring amino acid
  misc_feature (41)..(43): Xaa can be any naturally occurring amino acid
  misc_feature (55)..(55): Xaa can be any naturally occurring amino acid
  misc_feature (58)..(59): Xaa can be any naturally occurring amino acid
  misc_feature (61)..(61): Xaa can be any naturally occurring amino acid
  misc_feature (64)..(64): Xaa can be any naturally occurring amino acid
  misc_feature (73)..(73): Xaa can be any naturally occurring amino acid
  misc_feature (75)..(75): Xaa can be any naturally occurring amino acid
QHAGGSMSQXLQAKVEIFXKMFISAGXEGTERCTXXXXLGXXXGHAAPYNRWILXEFXXNXKVXTELISYFSXTXGTPSASGFTNET

SEQ ID NO: 771 - protein, 151 aa, Homo sapiens
  misc_feature (66)..(66): Xaa can be any naturally occurring amino acid
FFIFCRYEVSPCCSGWSQAPELKQPACLRLPKCWDHKHEPLCPAWHLICESHTISNRNIKIPGHFXSPRLGQLHSLTCSVLPQSQCGTRLQAQHWGCADRSWFKSQLPALEPYSDLSAPRLPQRVLLQPVSQCTCPAHELTELMASESECL

SEQ ID NO: 772 - protein, 159 aa, Homo sapiens
  misc_feature (156)..(156): Xaa can be any naturally occurring amino acid
ELPEKKKMKYIQDFQREKQEFERNLARFREDHPDLIQNAKKSDIPEKPKTPQQLWYTHEKKVYLKVRPDEIMRDYIQKHPELNISEEGITKSTLTKAERQLKDKFDGRPTKPPPNSYSLYCAELMANMKDVPSTEAHGAVQPAVEAAVPEGEGRLXQEV

SEQ ID NO: 773 - protein, 151 aa, Homo sapiens
KKERKWGRPGGQGTEHGGETKVVSWGGELLGSPWLPWGGAEPQLESESEESPEEEELELLPSDSLSSSSSSSSSSSSSSSSSSSSSSSSDSDLDCRVVRLDLGFGPRSLVMLLRLLEMYSLYAARSWGDRLLTQRSRCTLYCFCCSSASFL

SEQ ID NO: 774 - protein, 140 aa, Homo sapiens
  misc_feature (127)..(127): Xaa can be any naturally occurring amino acid
  misc_feature (139)..(140): Xaa can be any naturally occurring amino acid
GGGAGAAALGLIIFILIVILVVVFVLVILILFIILLGLRLGLQSSPAGFGVWASQLGHALTFIGDVLFICCTVLGRQALNPEVQVHLVLLLLLLGQLFVSAPSGSGRCAASDCRSPPCAPSAAGGSXPHWNSSSWEELXX

SEQ ID NO: 775 - protein, 130 aa, Homo sapiens
RSAWWRSAVAGSASPRARRSTYKKLAEEQQKQYKVHLDLWVKSLSPQDRAAYKEYISNKRKSMTKLRGPNPKSSRTTLQSKSESEEDDEEDEDDEDEDDDEDDDEDEDNESEGSSSSSSSSGDSSDSDSN

SEQ ID NO: 776 - protein, 165 aa, Homo sapiens
PPALPLPVPRSARHEIPRRGATRGRVGEAQRQPLPAMEEEARGAHLRPPEPVPRQPPRAPQGAALPLHPQGGLRGAHGQVRVLHHRHHRPQGDRLPLRGRELLERGHRAGAHRFPEPPRPAGLSQPPGTHRPAAPAEDAVAAAAAAPSEPSEPSRPSPQPKPRTP

SEQ ID NO: 777 - protein, 158 aa, Homo sapiens
  misc_feature (142)..(142): Xaa can be any naturally occurring amino acid
  misc_feature (145)..(145): Xaa can be any naturally occurring amino acid
ACSPPAPARAPRSCASTPSSRWTAWSARASTCTSPSSPPTTRRSTSAARARAAGTRPSRWRSSISRTAAPCRTFAAARNAPTRRTRRGRRGCRGRRTLRALGALQAIPAAQTPHAMSPPRAIRWTSRTEARTWPALLQPCSXKNXPCARILASVQRAP

SEQ ID NO: 778 - protein, 179 aa, Homo sapiens
RPHCRSQSRARHDMKSPDEVLREGELEKRSDSLFQLWKKKRGVLTSDRLSLFPASPRARPKELRFHSILKVDCVERTGKYVYFTIVTTDHKEIDFRCAGESCWNAAIALALIDFQNRRALQDFRSRQERTDPPHPPRTPWLPRPPHPPSPRSPPGHPRSPNPARHEPAAGHTLDESDRG

SEQ ID NO: 779 - protein, 179 aa, Homo sapiens [sequence omitted]

SEQ ID NO: 780 - protein, 134 aa, Homo sapiens
  misc_feature (69)..(69): Xaa can be any naturally occurring amino acid
  misc_feature (99)..(99): Xaa can be any naturally occurring amino acid
  misc_feature (104)..(104): Xaa can be any naturally occurring amino acid
  misc_feature (114)..(114): Xaa can be any naturally occurring amino acid
  misc_feature (117)..(117): Xaa can be any naturally occurring amino acid
  misc_feature (123)..(123): Xaa can be any naturally occurring amino acid
  misc_feature (128)..(129): Xaa can be any naturally occurring amino acid
AWRCTRVSEALLLSARQEDVCRRRSAGPVAFTVLCLSRPSRLPTAAIPPYSPSGTWRWSVQALACNQHXSLGLVQEGSSGKAPSSFPARLGPATVRLRXGLKEXAGPEFPLARXELXTKGRRXPPGRXXVPPLA

SEQ ID NO: 781 - protein, 130 aa, Homo sapiens
  misc_feature (124)..(124): Xaa can be any naturally occurring amino acid
GGMAAVGSLLGRLRQSTVKATGPALRRLHTSSWRADSSRASLTRVHRQAYARLYPVLLVKQDGSTIHIRYREPRRMLAMPIDLDTLSPEERRARLRKREAQLQSRKEYEQELSDDLHVERYRQXWTRTKK

SEQ ID NO: 782 - protein, 56 aa, Homo sapiens
NDVPNQFLVYSFPKSKITKVLKVHKTDLHLCIPFQINPKSMYSMFNSMQYAKALCC

SEQ ID NO: 783 - protein, 55 aa, Homo sapiens
NDVPNQFLVYSFPKSKITKVLKVHKTDLHLCIPFQINPKSMYSMFNSMQYAKALC

SEQ ID NO: 784 - protein, 259 aa, Homo sapiens
  misc_feature (234)..(234): Xaa can be any naturally occurring amino acid
  misc_feature (249)..(249): Xaa can be any naturally occurring amino acid
  misc_feature (252)..(252): Xaa can be any naturally occurring amino acid
  misc_feature (256)..(256): Xaa can be any naturally occurring amino acid
KLSALFINLISDPSRWVRQAAFQSLGPFISTFANPSSSGQYFKEESKSSEEMSVENKNRTRDQEAPEDVQVRPEDTPSDLSVSNSSVILENTMEDHAAEASGKPLGEISVPLDSSLLCTLSSESHQEAASNENDKKPGNYKSMLRPEVGTTSQDSALLDQELYNSFHFWRTPLPEIDLDIELEQNSGGKPSPEGPEEESEGPVPSSPNITMATRKELEEMIENLEPPIDDPDGXAQVGSAVRCTTCFQXWDXHEEXHRF

SEQ ID NO: 785 - protein, 103 aa, Homo sapiens
  misc_feature (9)..(9): Xaa can be any naturally occurring amino acid
  misc_feature (95)..(95): Xaa can be any naturally occurring amino acid
  misc_feature (99)..(99): Xaa can be any naturally occurring amino acid
  misc_feature (101)..(101): Xaa can be any naturally occurring amino acid
ILFGQENLXHNSLNSMIKDCSTPKSGHRYVQYVKKLHLRADHDQVKNTRHTLYRLINFLQVMTSMKKSDTDTQQPFCKCVQQYAALKSLSQSYLXWHQXLXEM

SEQ ID NO: 786 - protein, 218 aa, Homo sapiens
  misc_feature (208)..(208): Xaa can be any naturally occurring amino acid
  misc_feature (211)..(211): Xaa can be any naturally occurring amino acid
ELEDKVAACQKEQADFLPRIEETKWEVCQKAGEISLLKQQLKDSQADVSQKLSEIVGLRSQLREGRASLREKEEQLLSLRDSFSSKQASLELGEGELPAACLKPALTPVDPAEPQDALATCESDEAKMRRQAGVAAAASLVSVDGEAEAGGESGTRALRREVGRLQAELAAERRARERQGASFAEERRVWLEEKEKVIEYPESSLQLXLRXRCTNRNP

SEQ ID NO: 787 - protein, 208 aa, Homo sapiens
  misc_feature (1)..(1): Xaa can be any naturally occurring amino acid
XQLQAAFWVLDHLLLFLKPNAALLGEAGTLALPGPPLSRQLGLQPPHLPPQGPRPALPASLRLPVHGNQGGGSGHPGLTAHLSLVALAGGQSILWLGRVHGGQRRLEAGGRQLAFAQLQAGLLAAEGVPQAEQLLLLLPQRSPALPQLRAQSHDLTQLLRHIRLRVLQLLLQEGDLASLLAHLPLSFLYPGQEVGLLLLAGGHLVLQL

SEQ ID NO: 788 - protein, 130 aa, Homo sapiens
RRILASSLSQVARASCGSAGSTGVSAGLRQAAGSSPSPSSRLACLLLKESRRLSSCSSFSRSEARPSRSCERSPTISLNFCDTSACESFSCCFRREISPAFWHTSHLVSSIRGRKSACSFWQAATLSSSS

SEQ ID NO: 789 - protein, 252 aa, Homo sapiens
  misc_feature (232)..(232): Xaa can be any naturally occurring amino acid
  misc_feature (235)..(235): Xaa can be any naturally occurring amino acid
  misc_feature (249)..(249): Xaa can be any naturally occurring amino acid
VPQGYPGGVPTFFRDMKQGLLSVGIGGRESRNGCLDVEKDCSITKFLNRILGLEVHKQNALFQYFSDTFDHLIEMDKREGKYDMGILDLAPGIEEIYEESQQVFLAPGHPQDGQVVFYKISVDRGLKWEDAFAKSLALTGPYDGFYLSYKVRGNKPSCLLAEQNRGQFFTVYKPNIGRQSQLEALDSLRRKFHRVTAEEAKGALGEWLRFVADALQATAPGTGTCRLAQEGXGLXAGACGLRHQLHACXAPL

SEQ ID NO: 790 - protein, 94 aa, Homo sapiens
  misc_feature (89)..(89): Xaa can be any naturally occurring amino acid
RGQGRAGGGRIAYISRGLPHGAPETRGPEHLGFPEFLALGTTRFHGFQGFGPTEPLWVPSPRAATRSPFLLGRRGTERALPRPGPQLSXWAPQG

SEQ ID NO: 791 - protein, 225 aa, Homo sapiens
  misc_feature (212)..(212): Xaa can be any naturally occurring amino acid
LKAKDQGKPEVGEYAKLEKINAEQQLKIQELQEKLEKAVKASTEATELLQNIRQAKERAERELEKLQNREDSSEGIRKKLVEAEERRHSLENKVKRLETMERRENRLKDDIQTKSQQIQQMADKILELEEKHREAQVSAQHLEVHLKQKEQHYEEKIKVLDNQIKKDLADKETLENMMQRHEEEAHEKGKILSEQKAMINAMDSKIRSLEQXIVELSEANKLAAK

SEQ ID NO: 792 - protein, 129 aa, Homo sapiens
  misc_feature (10)..(10): Xaa can be any naturally occurring amino acid
  misc_feature (20)..(20): Xaa can be any naturally occurring amino acid
  misc_feature (78)..(79): Xaa can be any naturally occurring amino acid
  misc_feature (97)..(97): Xaa can be any naturally occurring amino acid
  misc_feature (109)..(109): Xaa can be any naturally occurring amino acid
NAKTERPIFXDLSKYWGPRXKTSANIQSNLPWGREGREYDPTDSKQHIKRHSRTFAKGATTWRFVGVSNKKALRLKHXXEGAGMQARLQSGKGSELXTQLKTRSCSPAXGETGLPLSLPKRCLGLLRRA

SEQ ID NO: 793 - protein, 92 aa, Homo sapiens
  misc_feature (17)..(17): Xaa can be any naturally occurring amino acid
  misc_feature (25)..(25): Xaa can be any naturally occurring amino acid
  misc_feature (55)..(55): Xaa can be any naturally occurring amino acid
  misc_feature (64)..(64): Xaa can be any naturally occurring amino acid
EYKVSCKYVQSFELVLXSRKQFTDXTHNIHFQGSRSPFLMEILNEMPRLKDPFSXTFPNTGDQXTKLQQTFNQICPGDGRGGSTTPQTPSNT

SEQ ID NO: 794 - protein, 219 aa, Homo sapiens
  misc_feature (201)..(201): Xaa can be any naturally occurring amino acid
SAMSSDRMDCGRKVRVESGYFSLEKTKQDLKAEEQQLPPPLSPPSPSTPNHRRSQVIEKFEALDIEKAEHMETNAVGPSQSSDTRQGRSEKRAFPRKRDFTNEAPPAPLPDASASPLSPHRRAKSLDRRSTEPSVTPDLLNFKKGWLTKQYEDGQWKKHWFVLADQSLRYYRDSVAEEAADLDGEIDLSACYDVTEYPVQXKLWLPDTYKGGRSLPLSP

SEQ ID NO: 795 - protein, 77 aa, Homo sapiens
  misc_feature (16)..(16): Xaa can be any naturally occurring amino acid
  misc_feature (19)..(19): Xaa can be any naturally occurring amino acid
  misc_feature (22)..(22): Xaa can be any naturally occurring amino acid
  misc_feature (34)..(34): Xaa can be any naturally occurring amino acid
  misc_feature (47)..(47): Xaa can be any naturally occurring amino acid
  misc_feature (55)..(55): Xaa can be any naturally occurring amino acid
RQQEVNTAESGVDNPXASXTHXMPTVNDDHNRNXNNNNKTKVQVKNXAWGVLLQXWGKRVLNFGWDTPSLSSSPWIK

SEQ ID NO: 796 - protein, 99 aa, Homo sapiens
  misc_feature (23)..(23): Xaa can be any naturally occurring amino acid
  misc_feature (31)..(31): Xaa can be any naturally occurring amino acid
  misc_feature (44)..(44): Xaa can be any naturally occurring amino acid
  misc_feature (56)..(56): Xaa can be any naturally occurring amino acid
  misc_feature (58)..(58): Xaa can be any naturally occurring amino acid
  misc_feature (62)..(62): Xaa can be any naturally occurring amino acid
  misc_feature (91)..(91): Xaa can be any naturally occurring amino acid
LIQGLEERLGVSHPKLSTRFPQXCSSTPQAXFFTWTFVLLLLLXLRLWSSLTVGMXCXRLAXGLSTPLSAVLTSCCLHQSFFPWYSKIRPXVGVGGHLC

SEQ ID NO: 797 - protein, 138 aa, Homo sapiens
IHTYIHTYIHTYIHTSIHAYRYTRKKKRKEKKEKMKEKALYCYWARAFSLSVSLCSSLSFSLCLFLCLSVSFFLSVSVSVFVSLSPSLPVSLCLSSVSLCLSMSFSVCLFLCLSASLFLFLCLSVGLSLSVCLSVSLS

SEQ ID NO: 798 - protein, 103 aa, Homo sapiens
KKRHCIATGLGPSLCLFLSVRLCLSLCVSFSVCLSLSFSLSLSLSLSLSLPLCLSHCVCLLSLSVCLCLSLSVSFSVCLPLSFFFCVSLSVSLSLSVCLSLSL

SEQ ID NO: 799 - protein, 95 aa, Homo sapiens
ERETDRQTERERPTERHRKRKREADRQRKRQTEKDIDRQRETEDRHSETGREGERETKTETETERKKETDRQRKRHREKDRDEQRETDREKALAQ

SEQ ID NO: 800 - protein, 100 aa, Homo sapiens
DRQRGRERDKDRDRDREKERDRQTEKETQRERQRRTERNRQREGPSPVAIQCLFFHFLFLFFSFFLSCISVCMDGCMYVCMYVCMYVCVYLFMYVFIWRP

SEQ ID NO: 801 - protein, 185 aa, Homo sapiens
TVGTAMAPVLSKDSADIESILALNPRTQTHATLCSTSAKKLDKKHWKRNPDKNCFNCEKLENNFDDIKHTTLGERGALREAMRCLKCADAPCQKSCPTNLDIKSFITSIANKNYYGAAKMIFSDNPLGLTCGMVCPTSDLCVGGCNLYATEEGPINIGGLQQFATEVCMIYTVTSPHYHHHAQIS

SEQ ID NO: 802 - protein, 155 aa, Homo sapiens; identical to SEQ ID NO: 645
  misc_feature (4)..(4): Xaa can be any naturally occurring amino acid
  misc_feature (37)..(37): Xaa can be any naturally occurring amino acid
  misc_feature (40)..(40): Xaa can be any naturally occurring amino acid
  misc_feature (54)..(54): Xaa can be any naturally occurring amino acid
  misc_feature (64)..(64): Xaa can be any naturally occurring amino acid
  misc_feature (81)..(81): Xaa can be any naturally occurring amino acid
  misc_feature (114)..(114): Xaa can be any naturally occurring amino acid
  misc_feature (124)..(124): Xaa can be any naturally occurring amino acid
  misc_feature (145)..(145): Xaa can be any naturally occurring amino acid

SEQ ID NO: 803 - protein, 200 aa, Homo sapiens; identical to SEQ ID NO: 646
  misc_feature (4)..(4): Xaa can be any naturally occurring amino acid
  misc_feature (9)..(9): Xaa can be any naturally occurring amino acid

SEQ ID NO: 804 - protein, 204 aa, Homo sapiens
  misc_feature (180)..(180): Xaa can be any naturally occurring amino acid
  misc_feature (196)..(196): Xaa can be any naturally occurring amino acid
AVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQXGTGASCWKKSFGPKGXKKNMIQEE

SEQ ID NO: 805 - protein, 187 aa, Homo sapiens
  misc_feature (9)..(9): Xaa can be any naturally occurring amino acid
  misc_feature (25)..(25): Xaa can be any naturally occurring amino acid
FFLDHILLXPFWAKRLFPAACSRSXLMSQLFIPLGKCLLQLLHILLVSEILVLDLTFLYPQSLLQLPTVCLAGIQGGLQGCSAGLQTAAQFCLLEEMLLFPLQGSMSLAKGLLQSLSPGPGSLLLMPGGLTFCPQSFQLLVPFLEHCLGLQPAVLQGPGLHLMLLCLLSTLLLEGQQSFLLLPRLSP

SEQ ID NO: 806 - protein, 105 aa, Homo sapiens
  misc_feature (17)..(17): Xaa can be any naturally occurring amino acid
DKKNSRWPSVGLKLQKXRWSCCKAQLTLERKQKQDYITRSAQTSRELAGLHHSLSHSLLAVAQAPEATVLEAETRRLDESLTQSLTSPGPVLLHPSPSTTQAASR

SEQ ID NO: 807 - protein, 256 aa, Homo sapiens; identical to SEQ ID NO: 640
  misc_feature (177)..(177): Xaa can be any naturally occurring amino acid
  misc_feature (198)..(198): Xaa can be any naturally occurring amino acid
  misc_feature (211)..(211): Xaa can be any naturally occurring amino acid
  misc_feature (218)..(218): Xaa can be any naturally occurring amino acid
  misc_feature (226)..(226): Xaa can be any naturally occurring amino acid
  misc_feature (235)..(235): Xaa can be any naturally occurring amino acid
  misc_feature (238)..(238): Xaa can be any naturally occurring amino acid
  misc_feature (255)..(255): Xaa can be any naturally occurring amino acid

SEQ ID NO: 808 - protein, 88 aa, Homo sapiens
KSERAQWLSRKQLTTRSTRSGQRLPSWVRHALREDSTSPARKGQQAQCPYGAHMAGNSSRTPLPKLSTSPTRGSYSWQKRLHEPTTVN

SEQ ID NO: 809 - protein, 96 aa, Homo sapiens
GKTPPALPGKGSRRSAPMGPTWLVTAAGHLFQSCPPAPLGAPTHGKKDYMSPQLSTNTVPPPPKANTYTYNVKNLLSEQQCSRPWPWSLKVLCHWL

SEQ ID NO: 810 - protein, 178 aa, Homo sapiens; identical to SEQ ID NO: 641

SEQ ID NO: 811 - protein, 294 aa, Homo sapiens
  misc_feature (213)..(213): Xaa can be any naturally occurring amino acid
  misc_feature (219)..(219): Xaa can be any naturally occurring amino acid
  misc_feature (258)..(258): Xaa can be any naturally occurring amino acid
  misc_feature (260)..(260): Xaa can be any naturally occurring amino acid
  misc_feature (283)..(283): Xaa can be any naturally occurring amino acid
  misc_feature (285)..(285): Xaa can be any naturally occurring amino acid
  misc_feature (288)..(288): Xaa can be any naturally occurring amino acid
  misc_feature (293)..(293): Xaa can be any naturally occurring amino acid
RMCGRTSCHLPRDVLTRACAYQDRRGQQRLPEWRDPDKYCPSYNKSPQSNSPVLLSRLHFEKDADSSERIIAPMRWGLVPSWFKESDPSKLQFNTTNCRSDTVMEKRSFKVPLGKGRRCVVLADGFYEWQRCQGTNQRQPYFIYFPQIKTEKSGSIGAADSPENWEKVWDNWRLLTMAGIFDCWEPPEGGDVLYSYTIITVDSCKGLSDIHHXMPAHIXMEKEAVSKMAWTLVKVFNLRKLLKFNPPNKRKFTFPCQXFXGGTNLRKQHFPEWFGFLSTLGGXKXNLXAKWEXP

SEQ ID NO: 812 - protein, 96 aa, Homo sapiens
  misc_feature (59)..(59): Xaa can be any naturally occurring amino acid
GKTPPALPGKGSRRSAPMGPTWLVTAAGHLFQSCPPAPLGAPTHGKKDYMSPQLSTNTXPPPPKANTYTYNVKNLLSEQQCSRPWPWSLKVLCHWL

SEQ ID NO: 813 - protein, 235 aa, Homo sapiens; identical to SEQ ID NO: 642
  misc_feature (206)..(206): Xaa can be any naturally occurring amino acid
  misc_feature (226)..(227): Xaa can be any naturally occurring amino acid
  misc_feature (231)..(231): Xaa can be any naturally occurring amino acid

SEQ ID NO: 814 - protein, 59 aa, Homo sapiens
LNNILFMLQKMPYFKNQSFCPVKKSIVKVKHQFLNCTLYIKMLIHYVKILKNIVLITAQ

SEQ ID NO: 815 - protein, 148 aa, Homo sapiens
  misc_feature (147)..(147): Xaa can be any naturally occurring amino acid
LCLVYVYMPNGSLLDRLSCLDGTPPLSWHMRCKIAQGAANGINFLHENHHIHRDIKSANILLDEAFTAKISDFGLARASEKFAQTVMTSRIVGTTAYMAPEALRGEITPKSDIYSFGVVLLEIITGLPAVDEHREPQLLLDIKRRNXR

SEQ ID NO: 816 - protein, 77 aa, Homo sapiens
NVTHLFIYLFMMESHSVTQAGVQWHDLSSLQPLPPWFQLVSCLSLPSSWDYRCPPPRSSNFCIFSKDGVSPCWPGRS

SEQ ID NO: 817 - protein, 83 aa, Homo sapiens
SPASASQVAGTTGVHHHARLIFVFLVKTGFHHVGQAGLELLTSGDLPASASQSAGIYRYEPPHPANVTHYLTVLYIRSPAQNR

SEQ ID NO: 818 - protein, 169 aa, Homo sapiens; identical to SEQ ID NO: 647

SEQ ID NO: 819 - protein, 139 aa, Homo sapiens; identical to SEQ ID NO: 648
  misc_feature (7)..(7): Xaa can be any naturally occurring amino acid
  misc_feature (17)..(17): Xaa can be any naturally occurring amino acid
  misc_feature (20)..(20): Xaa can be any naturally occurring amino acid
  misc_feature (26)..(26): Xaa can be any naturally occurring amino acid
  misc_feature (34)..(34): Xaa can be any naturally occurring amino acid
  misc_feature (52)..(52): Xaa can be any naturally occurring amino acid
  misc_feature (59)..(59): Xaa can be any naturally occurring amino acid
  misc_feature (66)..(66): Xaa can be any naturally occurring amino acid
  misc_feature (69)..(69): Xaa can be any naturally occurring amino acid
  misc_feature (73)..(73): Xaa can be any naturally occurring amino acid
  misc_feature (75)..(75): Xaa can be any naturally occurring amino acid
  misc_feature (80)..(80): Xaa can be any naturally occurring amino acid
  misc_feature (83)..(84): Xaa can be any naturally occurring amino acid
  misc_feature (86)..(86): Xaa can be any naturally occurring amino acid
  misc_feature (102)..(102): Xaa can be any naturally occurring amino acid
  misc_feature (106)..(106): Xaa can be any naturally occurring amino acid
  misc_feature (110)..(110): Xaa can be any naturally occurring amino acid
  misc_feature (112)..(112): Xaa can be any naturally occurring amino acid
  misc_feature (117)..(118): Xaa can be any naturally occurring amino acid
  misc_feature (122)..(122): Xaa can be any naturally occurring amino acid
  misc_feature (125)..(126): Xaa can be any naturally occurring amino acid
  misc_feature (135)..(135): Xaa can be any naturally occurring amino acid
  misc_feature (137)..(137): Xaa can be any naturally occurring amino acid

SEQ ID NO: 820 - protein, 168 aa, Homo sapiens
  misc_feature (3)..(3): Xaa can be any naturally occurring amino acid
  misc_feature (11)..(12): Xaa can be any naturally occurring amino acid
  misc_feature (27)..(27): Xaa can be any naturally occurring amino acid
  misc_feature (32)..(33): Xaa can be any naturally occurring amino acid
  misc_feature (43)..(43): Xaa can be any naturally occurring amino acid
  misc_feature (46)..(46): Xaa can be any naturally occurring amino acid
  misc_feature (50)..(51): Xaa can be any naturally occurring amino acid
  misc_feature (56)..(56): Xaa can be any naturally occurring amino acid
  misc_feature (59)..(59): Xaa can be any naturally occurring amino acid
  misc_feature (62)..(62): Xaa can be any naturally occurring amino acid
  misc_feature (66)..(66): Xaa can be any naturally occurring amino acid
  misc_feature (83)..(83): Xaa can be any naturally occurring amino acid
  misc_feature (85)..(86): Xaa can be any naturally occurring amino acid
  misc_feature (88)..(88): Xaa can be any naturally occurring amino acid
  misc_feature (93)..(93): Xaa can be any naturally occurring amino acid
  misc_feature (96)..(96): Xaa can be any naturally occurring amino acid
  misc_feature (99)..(99): Xaa can be any naturally occurring amino acid
  misc_feature (102)..(102): Xaa can be any naturally occurring amino acid
  misc_feature (110)..(110): Xaa can be any naturally occurring amino acid
  misc_feature (116)..(116): Xaa can be any naturally occurring amino acid
  misc_feature (135)..(135): Xaa can be any naturally occurring amino acid
  misc_feature (142)..(142): Xaa can be any naturally occurring amino acid
  misc_feature (149)..(149): Xaa can be any naturally occurring amino acid
  misc_feature (152)..(152): Xaa can be any naturally occurring amino acid
  misc_feature (162)..(162): Xaa can be any naturally occurring amino acid
PRXPTLPVNTXXDCSEKTREEGNFRKXFSPKXXTSLHLFHISXGKXPKHXXGLSEXQSXPLXQEHXKTCLSPGSFEMSLQPDXVXXDXTEFEXLPXSSXVKXCKHKEKSXHQKDFXLEFGEKSNAKIKDEDHSPXFENSDCXLKKMDKXGKXLKKHKLKHKXREKEKH

SEQ ID NO: 821 - protein, 176 aa, Homo sapiens
  misc_feature (120)..(120): Xaa can be any naturally occurring amino acid
  misc_feature (147)..(147): Xaa can be any naturally occurring amino acid
  misc_feature (151)..(151): Xaa can be any naturally occurring amino acid
LSFVKEIKECRRIENLWKNRMHEKARKAEEMRRQQKLKQAKLVEQYREQSWMTMANLEKELQEMEARYEKEFGDGSDENEMEEHELKDEEDGKDSDEAEDAELYDDLYCPACDKSFKTEXAMKNHEKSKKHREMVALLKQQLEEEEXNFSXPQIDENPLDDNSEEEMEDAPKQKLS

SEQ ID NO: 822 - protein, 193 aa, Homo sapiens
  misc_feature (3)..(3): Xaa can be any naturally occurring amino acid
IRXKARKEKNELVRQLVAFIRKRDKRVQAHRKLVEEQNAEKARKAEEMRRQQKLKQAKLVEQYREQSWMTMANLEKELQEMEARYEKEFGDGSDENEMEEHELKDEEDGKDSDEAEDAELYDDLYCPACDKSFKTEKAMKNHEKSKKHREMVALLKQQLEEEEENFSRPQIDENPLDDNSEEEMEDAPKQKLS

SEQ ID NO: 823 - protein, 253 aa, Homo sapiens
  misc_feature (224)..(225): Xaa can be any naturally occurring amino acid
  misc_feature (249)..(249): Xaa can be any naturally occurring amino acid
AVQASSGSPKARTTEGPVDSMPCLDRMPLLAKGKQATGEEKAATAPGAGAKASGEGMAGDAAGETEGSMERMGEPSQDPKQGTSGGVDTSSEQIATLTGFPDFREHIAKIFEKPVLGALATPGEKAGAGRSAVGKDLTRPLGPEKLLDGPPGVDVTLLPAPPARLQVEKKQQLAGEAEISHLALQDPASDKLLGPAGLTWERNLPGAGVGKEMAGCPTHTEGRXXGQKGLGQPGQAWKARLTYSLEKNXQELL

SEQ ID NO: 824 - protein, 242 aa, Homo sapiens
  misc_feature (18)..(19): Xaa can be any naturally occurring amino acid
VSLAFQAWPGCPRPFWPXXLPSVWVGQPAISFPTPAPGKFRSQVSPAGPRSLSEAGSCRARWEISASPANCCFFSTWSRAGGAGRRVTSTPGGPSRSFSGPNGLVRSLPTALLPAPAFSPGVARAPSTGFSKILAMCSLKSGKPVRVAICSELVSTPPDVPCFGSWEGSPILSMLPSVSPAASPAMPSPLALAPAPGAVAAFSSPVACLPLARSGIRSRHGMESTGPSVVLALGLPLLACTA

SEQ ID NO: 825 - protein, 82 aa, Homo sapiens
  misc_feature (6)..(6): Xaa can be any naturally occurring amino acid
  misc_feature (29)..(29): Xaa can be any naturally occurring amino acid
FYNLKXLKQQVMKYLLYYYTSGPAFSKKXLTCLRTLKKKALIWSFLGWGRLFQARQIFLLPLNWEYKKYITAKAAGNCILSQ

SEQ ID NO: 826 - protein, 64 aa, Homo sapiens
  misc_feature (6)..(6): Xaa can be any naturally occurring amino acid
  misc_feature (9)..(9): Xaa can be any naturally occurring amino acid
  misc_feature (20)..(20): Xaa can be any naturally occurring amino acid
  misc_feature (35)..(35): Xaa can be any naturally occurring amino acid
  misc_feature (40)..(40): Xaa can be any naturally occurring amino acid
  misc_feature (62)..(62): Xaa can be any naturally occurring amino acid
PLVLCXSCXPRFHPFGKRGXCARTQTHRNKLSASXAFGCXGAVCAHIYMHTTLVCMSRGNQXLN

SEQ ID NO: 827 - protein, 157 aa, Homo sapiens
  misc_feature (34)..(34): Xaa can be any naturally occurring amino acid
  misc_feature (37)..(37): Xaa can be any naturally occurring amino acid
  misc_feature (78)..(78): Xaa can be any naturally occurring amino acid
  misc_feature (81)..(82): Xaa can be any naturally occurring amino acid
  misc_feature (88)..(88): Xaa can be any naturally occurring amino acid
  misc_feature (93)..(93): Xaa can be any naturally occurring amino acid
  misc_feature (109)..(109): Xaa can be any naturally occurring amino acid
  misc_feature (111)..(111): Xaa can be any naturally occurring amino acid
  misc_feature (114)..(115): Xaa can be any naturally occurring amino acid
  misc_feature (124)..(124): Xaa can be any naturally occurring amino acid
  misc_feature (129)..(129): Xaa can be any naturally occurring amino acid
  misc_feature (131)..(131): Xaa can be any naturally occurring amino acid
  misc_feature (135)..(135): Xaa can be any naturally occurring amino acid
  misc_feature (137)..(139): Xaa can be any naturally occurring amino acid
  misc_feature (142)..(142): Xaa can be any naturally occurring amino acid
  misc_feature (144)..(144): Xaa can be any naturally occurring amino acid
  misc_feature (148)..(148): Xaa can be any naturally occurring amino acid
  misc_feature (150)..(150): Xaa can be any naturally occurring amino acid
  misc_feature (154)..(154): Xaa can be any naturally occurring amino acid
AWPALAPGSPVPAARPPRSRAPFRPGRSPAGMQXSPXGYGAQDDPPARRDCAWAPGHGAAADTRGLTAGPAALAAPAXPAXXPSPQRXPPRNXEPGRYGLSPAGRGERXAXYEXXIPLAHERLXGVGKXTXSKLXGXXXTRXCXNAVXQXRCWXKSV

SEQ ID NO: 828 - protein, 138 aa, Homo sapiens
  misc_feature (34)..(34): Xaa can be any naturally occurring amino acid
  misc_feature (36)..(36): Xaa can be any naturally occurring amino acid
  misc_feature (77)..(78): Xaa can be any naturally occurring amino acid
  misc_feature (81)..(81): Xaa can be any naturally occurring amino acid
  misc_feature (88)..(88): Xaa can be any naturally occurring amino acid
  misc_feature (93)..(93): Xaa can be any naturally occurring amino acid
  misc_feature (109)..(109): Xaa can be any naturally occurring amino acid
  misc_feature (111)..(111): Xaa can be any naturally occurring amino acid
  misc_feature (114)..(114): Xaa can be any naturally occurring amino acid
  misc_feature (123)..(123): Xaa can be any naturally occurring amino acid
  misc_feature (128)..(128): Xaa can be any naturally occurring amino acid
  misc_feature (131)..(131): Xaa can be any naturally occurring amino acid
  misc_feature (134)..(134): Xaa can be any naturally occurring amino acid
  misc_feature (137)..(138): Xaa can be any naturally occurring amino acid
PGLPLRPAPQCPPPARRAPALRSAQAAAQLECKXRXPATAHRTTRPPAATVHGPRDTGPPLTRAASPPAPPPSPRPXXPPXRPARSAXPRATXSRGAMASARPAAGNAXRXTSXASRWPMNAXMGWAXGRXASXLAXX

SEQ ID NO: 829 - protein, 164 aa, Homo sapiens
  misc_feature (2)..(2): Xaa can be any naturally occurring amino acid
  misc_feature (4)..(4): Xaa can be any naturally occurring amino acid
  misc_feature (11)..(11): Xaa can be any naturally occurring amino acid
  misc_feature (15)..(15): Xaa can be any naturally occurring amino acid
  misc_feature (17)..(17): Xaa can be any naturally occurring amino acid
  misc_feature (21)..(21): Xaa can be any naturally occurring amino acid
  misc_feature (23)..(23): Xaa can be any naturally occurring amino acid
  misc_feature (26)..(28): Xaa can be any naturally occurring amino acid
  misc_feature (30)..(30): Xaa can be any naturally occurring amino acid
  misc_feature (34)..(34): Xaa can be any naturally occurring amino acid
  misc_feature (36)..(36): Xaa can be any naturally occurring amino acid
  misc_feature (41)..(41): Xaa can be any naturally occurring amino acid
  misc_feature (50)..(51): Xaa can be any naturally occurring amino acid
  misc_feature (54)..(54): Xaa can be any naturally occurring amino acid
  misc_feature (56)..(56): Xaa can be any naturally occurring amino acid
  misc_feature (72)..(72): Xaa can be any naturally occurring amino acid
  misc_feature (77)..(77): Xaa can be any naturally occurring amino acid
  misc_feature (83)..(84): Xaa can be any naturally occurring amino acid
  misc_feature (87)..(87): Xaa can be any naturally occurring amino acid
  misc_feature (128)..(128): Xaa can be any naturally occurring amino acid
  misc_feature (131)..(131): Xaa can be any naturally occurring amino acid
RXVXAPSHAFXPASXLXHRVXAXPGXXXAXQLAXRXFAHPXKAFMGQRDXXLVXRXAFPAAGRAEAIAPRLXVARGXALRAGXXGGXGGRGEGGGAGGEAARVSGGPVSRGPCTVAAGGRVVLCAVAXRRXLHSSWAAAWAERSAGARRAGGGHWGAGRKGRPG

SEQ ID NO: 830 - protein, 179 aa, Homo sapiens
PAFIGEVNHKEIKMSKSKDDAPHELESQFILRLPPEYASTVRRAVQSGHVNLKDRLTIELHPDGRHGIVRVDRVPLASKLVDLPCVMESLKTIDKKTFYKTADICQMLVSTVDGDLYPPVEEPVASTDPKASKKKDKDKEKKFIWNHGITLPLKNVRKKKVPEDSQRRNILNLQMLKKK

SEQ ID NO: 831 - protein, 135 aa, Homo sapiens
LGNRKANGGSPGTVFGPESPAEILSTHKLSRNKDTQKIRAQRALFASGTYNPVTIISSVSPGRSEGKRRPQGAKRERAERLLVVSLILPAAWQSDPLPITDERARDGQREILPRGAARITRPRTSPALRPGRLPS

SEQ ID NO: 832 - protein, 113 aa, Homo sapiens
PAFIGEVNHKEIKMSKSKDDAPHELESQFILRLPPEYASTVRRAVQSGHVNLKDRLTIELHPDGRHGIVRVDRVPLASKLVDLPCVMESLKTIDKKTFYKTADICQMLVSTVD

SEQ ID NO: 833 - protein, 134 aa, Homo sapiens
  misc_feature (23)..(23): Xaa can be any naturally occurring amino acid
  misc_feature (41)..(42): Xaa can be any naturally occurring amino acid
  misc_feature (53)..(53): Xaa can be any naturally occurring amino acid
  misc_feature (61)..(61): Xaa can be any naturally occurring amino acid
  misc_feature (68)..(69): Xaa can be any naturally occurring amino acid
  misc_feature (76)..(76): Xaa can be any naturally occurring amino acid
  misc_feature (79)..(79): Xaa can be any naturally occurring amino acid
  misc_feature (86)..(86): Xaa can be any naturally occurring amino acid
  misc_feature (94)..(96): Xaa can be any naturally occurring amino acid
  misc_feature (101)..(101): Xaa can be any naturally occurring amino acid
  misc_feature (103)..(103): Xaa can be any naturally occurring amino acid
  misc_feature (106)..(106): Xaa can be any naturally occurring amino acid
  misc_feature (117)..(117): Xaa can be any naturally occurring amino acid
  misc_feature (120)..(120): Xaa can be any naturally occurring amino acid
  misc_feature (124)..(124): Xaa can be any naturally occurring amino acid
  misc_feature (131)..(132): Xaa can be any naturally occurring amino acid
  misc_feature (134)..(134): Xaa can be any naturally occurring amino acid
AHPVSLKSVLRARFSTFMMRPLXVLPCPGLLELAFHVGNLXXNSITSWMGPSXSWGWSSEXINLGLDXXSKTSSGXEGXIFLSGRXGLFYPTGXXXGWKSXQXICXKNMACRDKILXKKXGLIXPFVISHXXPX

SEQ ID NO: 834 - protein, 128 aa, Homo sapiens
LGNRKANGGSPGTVFGPESPAEILSTHKLSRNKDTQKIRAQRALFASGTYNPVTIISSVSPGRSEGKRRPQGAKRERAERLLVVSLILPAAWQSDPLPITDERARDGQREILPRGAARITRPRTSPAL

SEQ ID NO: 835 - protein, 78 aa, Homo sapiens
RAGEVRGLVMRAAPLGKISRCPSRALSSVIGSGSLCQAAGRIKETTRRRSALSRLAPCGLLFPSLRPGETELIIVTGL

SEQ ID NO: 836 - protein, 107 aa, Homo sapiens
  misc_feature (13)..(13): Xaa can be any naturally occurring amino acid
  misc_feature (41)..(41): Xaa can be any naturally occurring amino acid
  misc_feature (60)..(60): Xaa can be any naturally occurring amino acid
  misc_feature (62)..(62): Xaa can be any naturally occurring amino acid
  misc_feature (65)..(65): Xaa can be any naturally occurring amino acid
  misc_feature (68)..(68): Xaa can be any naturally occurring amino acid
  misc_feature (71)..(71): Xaa can be any naturally occurring amino acid
  misc_feature (84)..(84): Xaa can be any naturally occurring amino acid
  misc_feature (87)..(87): Xaa can be any naturally occurring amino acid
  misc_feature (91)..(91): Xaa can be any naturally occurring amino acid
  misc_feature (94)..(94): Xaa can be any naturally occurring amino acid
  misc_feature (102)..(102): Xaa can be any naturally occurring amino acid
  misc_feature (106)..(106): Xaa can be any naturally occurring amino acid
LLLQRAELLLFSXFLLVELIQYSLKSVLESQISTFMMRPLXGLPCPGLLGAWLYGGNLLXKXHNXLDXVLXFPGAGHLDQLTWXGTXFSKXSSXQRRLYLLXLGGXG

SEQ ID NO: 837 - protein, 87 aa, Homo sapiens
  misc_feature (10)..(10): Xaa can be any naturally occurring amino acid
  misc_feature (13)..(13): Xaa can be any naturally occurring amino acid
  misc_feature (16)..(16): Xaa can be any naturally occurring amino acid
  misc_feature (19)..(19): Xaa can be any naturally occurring amino acid
  misc_feature (21)..(21): Xaa can be any naturally occurring amino acid
  misc_feature (40)..(40): Xaa can be any naturally occurring amino acid
  misc_feature (68)..(68): Xaa can be any naturally occurring amino acid
LIQMTSPRKXKDXIQXVMXFXKQIATIKPSSQEPRTGQTXKRSHHESGNLALKNRFQAVLDELNQKEXREKEQLSSLQEELESLLEK

SEQ ID NO: 838 - protein, 183 aa, Homo sapiens
  misc_feature (157)..(157): Xaa can be any naturally occurring amino acid
  misc_feature (170)..(171): Xaa can be any naturally occurring amino acid
  misc_feature (174)..(174): Xaa can be any naturally occurring amino acid
PAFIGEVNHKEIKMSKSKDDAPHELESQFILRLPPEYASTVRRAVQSGHVNLKDRLTIELHPDGRHGIVRVDRVPLASKLVDLPCVMESLKTIDKKTFYKTADICQMLVSTVDGDLYPPVEEPVASTDPKASKKKDKDKEKKFIWNHGITLPLKNVXEEKGSGRQPKKKXXESXDVEKEVKRC

SEQ ID NO: 839 - protein, 64 aa, Homo sapiens
  misc_feature (13)..(13): Xaa can be any naturally occurring amino acid
  misc_feature (27)..(27): Xaa can be any naturally occurring amino acid
  misc_feature (41)..(41): Xaa can be any naturally occurring amino acid
  misc_feature (60)..(60): Xaa can be any naturally occurring amino acid
LLLQRAELLLFSXFLLFELIPVQAWKXVLEKPDFPLSWMRXLLSFLPCPGSFGALPFHGXNLAS

SEQ ID NO: 840 - protein, 79 aa, Homo sapiens
  misc_feature (11)..(11): Xaa can be any naturally occurring amino acid
  misc_feature (30)..(30): Xaa can be any naturally occurring amino acid
  misc_feature (42)..(43): Xaa can be any naturally occurring amino acid
  misc_feature (49)..(49): Xaa can be any naturally occurring amino acid
  misc_feature (51)..(51): Xaa can be any naturally occurring amino acid
  misc_feature (61)..(61): Xaa can be any naturally occurring amino acid
  misc_feature (64)..(64): Xaa can be any naturally occurring amino acid
  misc_feature (67)..(67): Xaa can be any naturally occurring amino acid
  misc_feature (69)..(70): Xaa can be any naturally occurring amino acid
  misc_feature (75)..(76): Xaa can be any naturally occurring amino acid
EARFSTFMDEXPLVVFALSWVFWSLALSWXQSGFLNSHNPAXXGPFIFXGXGHFGFHLNLXPGXLAXSXXFSSRXXKEG

SEQ ID NO: 841 - protein, 57 aa, Homo sapiens
  misc_feature (17)..(17): Xaa can be any naturally occurring amino acid
  misc_feature (31)..(31): Xaa can be any naturally occurring amino acid
  misc_feature (45)..(45): Xaa can be any naturally occurring amino acid
KGKAPKDPGQGKNDKRXLIHESGKSGFSRTXFQACTGMSSNKRKXEKRSNSALCKRS

SEQ ID NO: 842 - protein, 57 aa, Homo sapiens
  misc_feature (11)..(11): Xaa can be any naturally occurring amino acid
  misc_feature (38)..(38): Xaa can be any naturally occurring amino acid
TPGTGQNRQEXSHHESGNLALKTDFQGLYWDELKQKEXREKEQLSSLQEELESLLEK

SEQ ID NO: 843 - protein, 50 aa, Homo sapiens
  misc_feature (11)..(11): Xaa can be any naturally occurring amino acid
  misc_feature (38)..(38): Xaa can be any naturally occurring amino acid
PQGQGKTDKRXLIMKVEIWLSRQIFRACTGMSSNKRKXEKRSNSALCKRS

SEQ ID NO: 844 - protein, 85 aa, Homo sapiens
LGRRPGRRAGEVRGLVMRAAPLGKISRCPSRALSSVIGSGSLCQAAGRIKETTRRRSALSRLAPCGLLFPSLRPGETELIIVTGL

SEQ ID NO: 845 - protein, 95 aa, Homo sapiens
LAREQESKWRLPRNGFRPRKPSRDTFNSQTLPEQRHSKNQGSASSLRLGYLQSSDDYKFSFTGPERREEEAARSQAGESRASPCRFLNSSCRLAE

SEQ ID NO: 846 - protein, 135 aa, Homo sapiens; identical to SEQ ID NO: 831

SEQ ID NO: 847 - protein, 133 aa, Homo sapiens
LGNRKANGGSPGTVFGPESPAEILSTHKLSRNKDTQKIRAQRALFASGTYNPVTIISSVSPGRSEGKRRPQGAKRERAERLLVVSLILPAAWQSDPLPITDERARDGQREILPRGAARITRPRTSPALRPGRL

SEQ ID NO: 848 - protein, 84 aa, Homo sapiens
GRRPGRRAGEVRGLVMRAAPLGKISRCPSRALSSVIGSGSLCQAAGRIKETTRRRSALSRLAPCGLLFPSLRPGETELIIVTGL

SEQ ID NO: 849 - protein, 73 aa, Homo sapiens
  misc_feature (11)..(11): Xaa can be any naturally occurring amino acid
  misc_feature (16)..(16): Xaa can be any naturally occurring amino acid
  misc_feature (25)..(25): Xaa can be any naturally occurring amino acid
  misc_feature (27)..(27): Xaa can be any naturally occurring amino acid
  misc_feature (34)..(34): Xaa can be any naturally occurring amino acid
  misc_feature (39)..(39): Xaa can be any naturally occurring amino acid
  misc_feature (42)..(42): Xaa can be any naturally occurring amino acid
  misc_feature (46)..(46): Xaa can be any naturally occurring amino acid
  misc_feature (58)..(58): Xaa can be any naturally occurring amino acid
  misc_feature (64)..(64): Xaa can be any naturally occurring amino acid
AQPMKRAKGSXKKTPXGPGAKNRPXRXFSFHEKXKIWAXQEXISGXYLDELNQKEARXKEQLSXLQEELEIPP

SEQ ID NO: 850 - protein, 129 aa, Homo sapiens
LGNRKANGGSPGTVFGPESPAEILSTHKLSRNKDTQKIRAQRALFASGTYNPVTIISSVSPGRSEGKRRPQGAKRERAERLLVVSLILPAAWQSDPLPITDERARDGQREILPRGAARITRPRTSPALR

SEQ ID NO: 851 - protein, 95 aa, Homo sapiens; identical to SEQ ID NO: 845

SEQ ID NO: 852 - protein, 80 aa, Homo sapiens
GRRAGEVRGLVMRAAPLGKISRCPSRALSSVIGSGSLCQAAGRIKETTRRRSALSRLAPCGLLFPSLRPGETELIIVTGL

SEQ ID NO: 853 - protein, 166 aa, Homo sapiens
  misc_feature (7)..(8): Xaa can be any naturally occurring amino acid
  misc_feature (22)..(22): Xaa can be any naturally occurring amino acid
  misc_feature (25)..(25): Xaa can be any naturally occurring amino acid
  misc_feature (32)..(35): Xaa can be any naturally occurring amino acid
  misc_feature (39)..(39): Xaa can be any naturally occurring amino acid
  misc_feature (41)..(42): Xaa can be any naturally occurring amino acid
  misc_feature (44)..(44): Xaa can be any naturally occurring amino acid
  misc_feature (51)..(51): Xaa can be any naturally occurring amino acid
  misc_feature (53)..(53): Xaa can be any naturally occurring amino acid
  misc_feature (56)..(58): Xaa can be any naturally occurring amino acid
  misc_feature (61)..(62): Xaa can be any naturally occurring amino acid
  misc_feature (75)..(75): Xaa can be any naturally occurring amino acid
  misc_feature (77)..(77): Xaa can be any naturally occurring amino acid
PQGFFPXXSFINSNPMPVPTFXCRXRTTRKKXXXXVRNXKXXGXFPGTGFXPXKPXXXTFXXQLSRNKDTQKIRXQXAFFRLRGLSIPVTIISSVSPGRSEGKRRPQGAKRERAERLLVVSLILPAAWQSDPLPITDERARDGQREILPRGAARITRPRTSPALRP

SEQ ID NO: 854 - protein, 91 aa, Homo sapiens
  misc_feature (91)..(91): Xaa can be any naturally occurring amino acid
PGRRAGEVRGLVMRAAPLGKISRCPSRALSSVIGSGSLCQAAGRIKETTRRRSALSRLAPCGLLFPSLRPGETELIIVTGMERPRRRKKAX

SEQ ID NO: 855 - protein, 130 aa, Homo sapiens
  misc_feature (2)..(2): Xaa can be any naturally occurring amino acid
  misc_feature (4)..(4): Xaa can be any naturally occurring amino acid
  misc_feature (7)..(7): Xaa can be any naturally occurring amino acid
  misc_feature (10)..(10): Xaa can be any naturally occurring amino acid
  misc_feature (13)..(13): Xaa can be any naturally occurring amino acid
  misc_feature (15)..(15): Xaa can be any naturally occurring amino acid
  misc_feature (19)..(19): Xaa can be any naturally occurring amino acid
  misc_feature (21)..(21): Xaa can be any naturally occurring amino acid
  misc_feature (25)..(28): Xaa can be any naturally occurring amino acid
  misc_feature (33)..(33): Xaa can be any naturally occurring amino acid
  misc_feature (37)..(37): Xaa can be any naturally occurring amino acid
  misc_feature (42)..(42): Xaa can be any naturally occurring amino acid
  misc_feature (45)..(46): Xaa can be any naturally occurring amino acid
  misc_feature (48)..(48): Xaa can be any naturally occurring amino acid
  misc_feature (51)..(52): Xaa can be any naturally occurring amino acid
  misc_feature (57)..(57): Xaa can be any naturally occurring amino acid
  misc_feature (59)..(59): Xaa can be any naturally occurring amino acid
  misc_feature (63)..(63): Xaa can be any naturally occurring amino acid
  misc_feature (68)..(68): Xaa can be any naturally occurring amino acid
  misc_feature (72)..(72): Xaa can be any naturally occurring amino acid
  misc_feature (78)..(78): Xaa can be any naturally occurring amino acid
  misc_feature (81)..(81): Xaa can be any naturally occurring amino acid
  misc_feature (87)..(88): Xaa can be any naturally occurring amino acid
  misc_feature (97)..(97): Xaa can be any naturally occurring amino acid
  misc_feature (99)..(99): Xaa can be any naturally occurring amino acid
  misc_feature (102)..(102): Xaa can be any naturally occurring amino acid
  misc_feature (117)..(117): Xaa can be any naturally occurring amino acid
  misc_feature (127)..(127): Xaa can be any naturally occurring amino acid
SXRXITXSFXPGXKXWEKXSXQGPXXXXFQMGXAPRXNEGTXIPXXVXGIXXSQDCXTXKRAXFQKAXRTGXNGPKGXSFXKGGKFXXSKNKFSGCXGXAQXKGSPRKGATQLFARXARITPREVKXTDI

SEQ ID NO: 856 - protein, 119 aa, Homo sapiens
  misc_feature (2)..(2): Xaa can be any naturally occurring amino acid
  misc_feature (4)..(5): Xaa can be any naturally occurring amino acid
  misc_feature (8)..(9): Xaa can be any naturally occurring amino acid
  misc_feature (14)..(14): Xaa can be any naturally occurring amino acid
  misc_feature (16)..(16): Xaa can be any naturally occurring amino acid
  misc_feature (20)..(22): Xaa can be any naturally occurring amino acid
  misc_feature (28)..(28): Xaa can be any naturally occurring amino acid
  misc_feature (31)..(31): Xaa can be any naturally occurring amino acid
  misc_feature (37)..(37): Xaa can be any naturally occurring amino acid
  misc_feature (39)..(40): Xaa can be any naturally occurring amino acid
  misc_feature (42)..(42): Xaa can be any naturally occurring amino acid
  misc_feature (46)..(47): Xaa can be any naturally occurring amino acid
  misc_feature (52)..(52): Xaa can be any naturally occurring amino acid
  misc_feature (54)..(54): Xaa can be any naturally occurring amino acid
  misc_feature (58)..(58): Xaa can be any naturally occurring amino acid
  misc_feature (63)..(63): Xaa can be any naturally occurring amino acid
  misc_feature (66)..(66): Xaa can be any naturally occurring amino acid
  misc_feature (72)..(72): Xaa can be any naturally occurring amino acid
  misc_feature (76)..(76): Xaa can be any naturally occurring amino acid
  misc_feature (82)..(82): Xaa can be any naturally occurring amino acid
  misc_feature (92)..(93): Xaa can be any naturally occurring amino acid
  misc_feature (97)..(97): Xaa can be any naturally occurring amino acid
  misc_feature (112)..(112): Xaa can be any naturally occurring amino acid
PXPXXPGXXFGKNXVXRAQXXXYSRWAXPPXKMKGPXFXXGXWEFXXARIAXPXKGQXSKKPXGQXKTDQRXSLSXKGENLXFQRTNFQAVXXELNXKEAREKEQLSSLQEXLESLLEK

SEQ ID NO: 857 - protein, 79 aa, Homo sapiens
  misc_feature (4)..(4): Xaa can be any naturally occurring amino acid
  misc_feature (6)..(7): Xaa can be any naturally occurring amino acid
  misc_feature (9)..(9): Xaa can be any naturally occurring amino acid
  misc_feature (13)..(13): Xaa can be any naturally occurring amino acid
  misc_feature (19)..(19): Xaa can be any naturally occurring amino acid
  misc_feature (21)..(21): Xaa can be any naturally occurring amino acid
  misc_feature (25)..(25): Xaa can be any naturally occurring amino acid
  misc_feature (30)..(30): Xaa can be any naturally occurring amino acid
  misc_feature (33)..(33): Xaa can be any naturally occurring amino acid
  misc_feature (39)..(39): Xaa can be any naturally occurring amino acid
  misc_feature (42)..(42): Xaa can be any naturally occurring amino acid
  misc_feature (49)..(49): Xaa can be any naturally occurring amino acid
  misc_feature (58)..(58): Xaa can be any naturally occurring amino acid
  misc_feature (60)..(60): Xaa can be any naturally occurring amino acid
  misc_feature (64)..(64): Xaa can be any naturally occurring amino acid
  misc_feature (78)..(78): Xaa can be any naturally occurring amino acid
RDPXSXXGXGNFXKPGLPXHXKGKXPKSPXDRXKRTKGXLFXERGKIWXFKEQIFRLXWXSSTXRKPEKRSNSALCKXS

SEQ ID NO: 858 - protein, 63 aa, Homo sapiens
  misc_feature (1)..(1): Xaa can be any naturally occurring amino acid
  misc_feature (5)..(5): Xaa can be any naturally occurring amino acid
  misc_feature (17)..(17): Xaa can be any naturally occurring amino acid
  misc_feature (20)..(20): Xaa can be any naturally occurring amino acid
  misc_feature (27)..(27): Xaa can be any naturally occurring amino acid
  misc_feature (29)..(29): Xaa can be any naturally occurring amino acid
  misc_feature (32)..(33): Xaa can be any naturally occurring amino acid
  misc_feature (48)..(48): Xaa can be any naturally occurring amino acid
  misc_feature (51)..(51): Xaa can be any naturally occurring amino acid
XLLQXAELPLFSGFLLXELXPVQPWKXVXENXXFPPFMERKTPWAVFXPGXGAFWEPGPFNGG

SEQ ID NO: 859 - protein, 76 aa, Homo sapiens
  misc_feature (1)..(1): Xaa can be any naturally occurring amino acid
  misc_feature (10)..(10): Xaa can be any naturally occurring amino acid
  misc_feature (12)..(12): Xaa can be any naturally occurring amino acid
  misc_feature (14)..(14): Xaa can be any naturally occurring amino acid
  misc_feature (18)..(18): Xaa can be any naturally occurring amino acid
  misc_feature (29)..(30): Xaa can be any naturally occurring amino acid
  misc_feature (33)..(33): Xaa can be any naturally occurring amino acid
  misc_feature (40)..(41): Xaa can be any naturally occurring amino acid
  misc_feature (45)..(46): Xaa can be any naturally occurring amino acid
  misc_feature (61)..(61): Xaa can be any naturally occurring amino acid
  misc_feature (64)..(64): Xaa can be any naturally occurring amino acid
XSGLFTSLGXDXSXSCKXLSCPFSRASFXXSSXQYSPGNXXLKTXXFPLSWKEKPLGRFLXLAXGLFGNLALLMGG

SEQ ID NO: 860 - protein, 71 aa, Homo sapiens
  misc_feature (13)..(13): Xaa can be any naturally occurring amino acid
  misc_feature (17)..(17): Xaa can be any naturally occurring amino acid
  misc_feature (31)..(31): Xaa can be any naturally occurring amino acid
  misc_feature (33)..(33): Xaa can be any naturally occurring amino acid
  misc_feature (36)..(36): Xaa can be any naturally occurring amino acid
  misc_feature (38)..(38): Xaa can be any naturally occurring amino acid
  misc_feature (44)..(44): Xaa can be any naturally occurring amino acid
  misc_feature (47)..(48): Xaa can be any naturally occurring amino acid
  misc_feature (60)..(60): Xaa can be any naturally occurring amino acid
  misc_feature (64)..(65): Xaa can be any naturally occurring amino acid
  misc_feature (67)..(67): Xaa can be any naturally occurring amino acid
APPLKGPGSQKAXGPGXKTAQGVFLSMKGGXFXFSXTXFQGCTXMSXXKRKPEKRGNSAXCKRXXNXLLEK

SEQ ID NO: 861 - protein, 138 aa, Homo sapiens
MAGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 862 - protein, 82 aa, Homo sapiens
LWSEMMESFIPPALPLPTHQNQGRGHIAVQQEQSFEPIQARCPLTNQTQTAREVTQTPAQIQPVSHHLQPQWYPNYRLFART

SEQ ID NO: 863 - protein, 84 aa, Homo sapiens
  misc_feature (81)..(82): Xaa can be any naturally occurring amino acid
  misc_feature (84)..(84): Xaa can be any naturally occurring amino acid
MIPSFRTKVTGTWTGCRTHLQPSRNAEMSGTTQSILSPHLYIVSASTSPNHTRKFGVKFCPVSSSIATSPPAIQLKALYHXXQX

SEQ ID NO: 864 - protein, 138 aa, Homo sapiens; identical to SEQ ID NO: 861

SEQ ID NO: 865 - protein, 218 aa, Homo sapiens
  misc_feature (12)..(12): Xaa can be any naturally occurring amino acid
  misc_feature (24)..(24): Xaa can be any naturally occurring amino acid
  misc_feature (46)..(46): Xaa can be any naturally occurring amino acid
  misc_feature (50)..(50): Xaa can be any naturally occurring amino acid
  misc_feature (53)..(53): Xaa can be any naturally occurring amino acid
FKGFPEKENGIXALFSKKKNISNXQAHSHVQKDPNKEMINDGRFLXNSLXQIXQEYTFYEGMGPVLAPVTPVPVVESLQLNGGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 866 - protein, 109 aa, Homo sapiens
  misc_feature (7)..(7): Xaa can be any naturally occurring amino acid
  misc_feature (11)..(11): Xaa can be any naturally occurring amino acid
  misc_feature (16)..(16): Xaa can be any naturally occurring amino acid
  misc_feature (22)..(22): Xaa can be any naturally occurring amino acid
  misc_feature (25)..(25): Xaa can be any naturally occurring amino acid
  misc_feature (77)..(77): Xaa can be any naturally occurring amino acid
  misc_feature (84)..(84): Xaa can be any naturally occurring amino acid
  misc_feature (91)..(91): Xaa can be any naturally occurring amino acid
  misc_feature (99)..(99): Xaa can be any naturally occurring amino acid
  misc_feature (103)..(103): Xaa can be any naturally occurring amino acid
  misc_feature (106)..(107): Xaa can be any naturally occurring amino acid
NYVQVWXKVCXCVVPXIFAFRXGWXWVRQPVQVPVTLVRNDGIIYSTSLTFTYTPEPGPRPHCSAAGAILRANSSQXPPNESNXNSEGSYXNASTNSTXVTSXTAXXVS

SEQ ID NO: 867 - protein, 98 aa, Homo sapiens
  misc_feature (12)..(12): Xaa can be any naturally occurring amino acid
  misc_feature (21)..(21): Xaa can be any naturally occurring amino acid
  misc_feature (23)..(23): Xaa can be any naturally occurring amino acid
  misc_feature (34)..(34): Xaa can be any naturally occurring amino acid
  misc_feature (49)..(49): Xaa can be any naturally occurring amino acid
  misc_feature (55)..(56): Xaa can be any naturally occurring amino acid
  misc_feature (65)..(65): Xaa can be any naturally occurring amino acid
  misc_feature (69)..(69): Xaa can be any naturally occurring amino acid
  misc_feature (74)..(74): Xaa can be any naturally occurring amino acid
  misc_feature (80)..(80): Xaa can be any naturally occurring amino acid
  misc_feature (83)..(83): Xaa can be any naturally occurring amino acid
GENGAPWSFGPXVHFLGALGXKXPFKFKWRVGTXQMLELTGQNFTPNLXSVVWGXXSLKLCTGVXKSMXLCRPXHFCIPXRLXMGPATSPGSSNFGPK

SEQ ID NO: 868 - protein, 102 aa, Homo sapiens
  misc_feature (18)..(18): Xaa can be any naturally occurring amino acid
  misc_feature (22)..(22): Xaa can be any naturally occurring amino acid
  misc_feature (28)..(28): Xaa can be any naturally occurring amino acid
  misc_feature (32)..(32): Xaa can be any naturally occurring amino acid
  misc_feature (36)..(36): Xaa can be any naturally occurring amino acid
  misc_feature (46)..(46): Xaa can be any naturally occurring amino acid
  misc_feature (53)..(53): Xaa can be any naturally occurring amino acid
  misc_feature (67)..(67): Xaa can be any naturally occurring amino acid
  misc_feature (78)..(78): Xaa can be any naturally occurring amino acid
  misc_feature (81)..(81): Xaa can be any naturally occurring amino acid
  misc_feature (90)..(90): Xaa can be any naturally occurring amino acid
FHHFGPKLLEPGLVAGPXSNLXGMQKCXGRHXSILXSTPVHSFKLXHPQTTLXKFGVKFCPVSSSIXYVPTRHLNLKXFFXPKAPRKWTXGPKDQGAPFSPQ

SEQ ID NO: 869 - protein, 115 aa, Homo sapiens
  misc_feature (23)..(23): Xaa can be any naturally occurring amino acid
  misc_feature (36)..(37): Xaa can be any naturally occurring amino acid
  misc_feature (46)..(46): Xaa can be any naturally occurring amino acid
  misc_feature (56)..(56): Xaa can be any naturally occurring amino acid
  misc_feature (71)..(71): Xaa can be any naturally occurring amino acid
  misc_feature (75)..(75): Xaa can be any naturally occurring amino acid
  misc_feature (79)..(80): Xaa can be any naturally occurring amino acid
  misc_feature (82)..(82): Xaa can be any naturally occurring amino acid
  misc_feature (86)..(86): Xaa can be any naturally occurring amino acid
  misc_feature (95)..(95): Xaa can be any naturally occurring amino acid
  misc_feature (101)..(101): Xaa can be any naturally occurring amino acid
  misc_feature (103)..(103): Xaa can be any naturally occurring amino acid
MIPSFRTKVTGTWTGCRTHFQPXRNAKMSGTTQSIXXPHLYIVSAXTSPNHTRKIXSENSVLVSSSIATSXPAIXTGRXXLXQGPXNELGGKGPXAPFPSXKXVLPLGPYFWGPK

SEQ ID NO: 870 - protein, 174 aa, Homo sapiens
  misc_feature (6)..(6): Xaa can be any naturally occurring amino acid
  misc_feature (8)..(8): Xaa can be any naturally occurring amino acid
  misc_feature (15)..(15): Xaa can be any naturally occurring amino acid
  misc_feature (24)..(24): Xaa can be any naturally occurring amino acid
  misc_feature (27)..(27): Xaa can be any naturally occurring amino acid
  misc_feature (30)..(31): Xaa can be any naturally occurring amino acid
  misc_feature (35)..(35): Xaa can be any naturally occurring amino acid
  misc_feature (38)..(38): Xaa can be any naturally occurring amino acid
  misc_feature (54)..(54): Xaa can be any naturally occurring amino acid
  misc_feature (64)..(64): Xaa can be any naturally occurring amino acid
  misc_feature (73)..(73): Xaa can be any naturally occurring amino acid
  misc_feature (87)..(87): Xaa can be any naturally occurring amino acid
  misc_feature (142)..(142): Xaa can be any naturally occurring amino acid
  misc_feature (149)..(149): Xaa can be any naturally occurring amino acid
  misc_feature (168)..(168): Xaa can be any naturally occurring amino acid
  misc_feature (171)..(171): Xaa can be any naturally occurring amino acid
GPRGNXFXIEGNGAXGPLPPSSFXGPXGKXXLPVXMAXGDVAMLELTRTEFSLXILRVWFGDVXAETMYRCGXSMLCVVPDIFAFRXGWKWVRQPVQVPVTLVRNDGIIYSTSLTFTYTPEPGPRPHCSAAGATLRANSSQXPPNESNXNSEGSYTNASTNSTSVTSXTAXVVS

SEQ ID NO: 871 - protein, 237 aa, Homo sapiens
  misc_feature (202)..(202): Xaa can be any naturally occurring amino acid
  misc_feature (217)..(217): Xaa can be any naturally occurring amino acid
  misc_feature (237)..(237): Xaa can be any naturally occurring amino acid
KTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQATPCPKEPNKEMINDGAXWTIISTDKAEYTFYXGMGPVLAPITPVPVVKKAFX

SEQ ID NO: 872 - protein, 179 aa, Homo sapiens
  misc_feature (12)..(12): Xaa can be any naturally occurring amino acid
  misc_feature (27)..(27): Xaa can be any naturally occurring amino acid
LNDGASWPFISXDKAEYTFYEGMGPVXAPVTPVPVVESLQLNGGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 873 - protein, 170 aa, Homo sapiens
  misc_feature (7)..(7): Xaa can be any naturally occurring amino acid
  misc_feature (22)..(22): Xaa can be any naturally occurring amino acid
  misc_feature (27)..(27): Xaa can be any naturally occurring amino acid
PRIGQSXHFYEGMGPCPCPSHXCACGXEPSVEWRVGTVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 874 - protein, 132 aa, Homo sapiens
  misc_feature (7)..(7): Xaa can be any naturally occurring amino acid
  misc_feature (41)..(41): Xaa can be any naturally occurring amino acid
QCLNFTXQNFTPNLRVWFGDVEAETMYRCGESMLCVVPDIXAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 875 - protein, 160 aa, Homo sapiens
  misc_feature (52)..(52): Xaa can be any naturally occurring amino acid
  misc_feature (66)..(66): Xaa can be any naturally occurring amino acid
  misc_feature (70)..(70): Xaa can be any naturally occurring amino acid
  misc_feature (76)..(76): Xaa can be any naturally occurring amino acid
  misc_feature (106)..(108): Xaa can be any naturally occurring amino acid
  misc_feature (111)..(111): Xaa can be any naturally occurring amino acid
  misc_feature (113)..(114): Xaa can be any naturally occurring amino acid
  misc_feature (120)..(121): Xaa can be any naturally occurring amino acid
  misc_feature (125)..(125): Xaa can be any naturally occurring amino acid
  misc_feature (131)..(131): Xaa can be any naturally occurring amino acid
  misc_feature (134)..(134): Xaa can be any naturally occurring amino acid
  misc_feature (136)..(136): Xaa can be any naturally occurring amino acid
  misc_feature (139)..(140): Xaa can be any naturally occurring amino acid
  misc_feature (146)..(146): Xaa can be any naturally occurring amino acid
  misc_feature (157)..(157): Xaa can be any naturally occurring amino acid
  misc_feature (159)..(159): Xaa can be any naturally occurring amino acid
IGSKDCSCCTAMWPRPWFWCVGKGKAGGINDSIISDQSYWNLDWLPDPSPTXSECKNVWDDTKHTXSTPXHKFQAXTSPNHTRKFGVKFCPVSSKHWYVPTAIQLXXXFHXPXXDWGKDXXHSLXKGYSGXSGXKXGQXXPHLSTXYLGLLEIGGAXNXI

SEQ ID NO: 876 - protein, 129 aa, Homo sapiens
  misc_feature (18)..(18): Xaa can be any naturally occurring amino acid
  misc_feature (24)..(24): Xaa can be any naturally occurring amino acid
  misc_feature (28)..(28): Xaa can be any naturally occurring amino acid
  misc_feature (42)..(42): Xaa can be any naturally occurring amino acid
  misc_feature (97)..(97): Xaa can be any naturally occurring amino acid
  misc_feature (111)..(111): Xaa can be any naturally occurring amino acid
  misc_feature (115)..(115): Xaa can be any naturally occurring amino acid
  misc_feature (123)..(123): Xaa can be any naturally occurring amino acid
  misc_feature (126)..(126): Xaa can be any naturally occurring amino acid
TYRTEFHSKFTSVVWGCXSLKLMXRCGXSMLCVVPDIFAFRXGWRWVRQPVQVPVTLVRNDGIIYSTSLTFTYTPEPGPRPHCSAAGAILRANSSQXPPNESNTNSEGSYXNASXNSTSVTSXTAXVVS

SEQ ID NO: 877 - protein, 126 aa, Homo sapiens
  misc_feature (1)..(1): Xaa can be any naturally occurring amino acid
  misc_feature (3)..(3): Xaa can be any naturally occurring amino acid
  misc_feature (15)..(15): Xaa can be any naturally occurring amino acid
  misc_feature (20)..(20): Xaa can be any naturally occurring amino acid
  misc_feature (22)..(22): Xaa can be any naturally occurring amino acid
  misc_feature (24)..(24): Xaa can be any naturally occurring amino acid
  misc_feature (26)..(26): Xaa can be any naturally occurring amino acid
  misc_feature (30)..(30): Xaa can be any naturally occurring amino acid
  misc_feature (35)..(35): Xaa can be any naturally occurring amino acid
  misc_feature (39)..(40): Xaa can be any naturally occurring amino acid
  misc_feature (46)..(47): Xaa can be any naturally occurring amino acid
  misc_feature (49)..(49): Xaa can be any naturally occurring amino acid
  misc_feature (53)..(54): Xaa can be any naturally occurring amino acid
  misc_feature (84)..(84): Xaa can be any naturally occurring amino acid
  misc_feature (90)..(90): Xaa can be any naturally occurring amino acid
  misc_feature (94)..(94): Xaa can be any naturally occurring amino acid
  misc_feature (108)..(108): Xaa can be any naturally occurring amino acid
XNXGPLQFPKDPNKXLINEXLXGXSXAQIXQSILXIRNXXCPCPSXXWXCGKXXSVEWRWGRTNALNLQDRISLQIYECGLGMXKLETYXQVWXEYALCRPRHFCIPXRLEMGPATSPGSSNFGPK

SEQ ID NO: 878 - protein, 159 aa, Homo sapiens
  misc_feature (5)..(5): Xaa can be any naturally occurring amino acid
  misc_feature (7)..(7): Xaa can be any naturally occurring amino acid
  misc_feature (18)..(19): Xaa can be any naturally occurring amino acid
  misc_feature (35)..(35): Xaa can be any naturally occurring amino acid
  misc_feature (49)..(49): Xaa can be any naturally occurring amino acid
  misc_feature (58)..(58): Xaa can be any naturally occurring amino acid
  misc_feature (61)..(61): Xaa can be any naturally occurring amino acid
  misc_feature (68)..(68): Xaa can be any naturally occurring amino acid
  misc_feature (72)..(72): Xaa can be any naturally occurring amino acid
  misc_feature (141)..(141): Xaa can be any naturally occurring amino acid
  misc_feature (153)..(153): Xaa can be any naturally occurring amino acid
  misc_feature (156)..(156): Xaa can be any naturally occurring amino acid
GKWAXSXAPVILVPVEKXXQLNGGGDVPMLELTGXNFTPNLRVWFGDVXAETMYRCGXSMXCVVPDIXAFRXGWRWVRQPVQVPVTLVRNDGIIYSTSLTFTYTPEPGPRPHCSAAGAILRANSSQVPPNESNTNSEGSYXNASTNSTSVTSXTAXVVS

SEQ ID NO: 879 - protein, 111 aa, Homo sapiens
  misc_feature (10)..(10): Xaa can be any naturally occurring amino acid
  misc_feature (13)..(13): Xaa can be any naturally occurring amino acid
  misc_feature (18)..(18): Xaa can be any naturally occurring amino acid
  misc_feature (20)..(20): Xaa can be any naturally occurring amino acid
  misc_feature (24)..(24): Xaa can be any naturally occurring amino acid
  misc_feature (49)..(49): Xaa can be any naturally occurring amino acid
  misc_feature (58)..(58): Xaa can be any naturally occurring amino acid
  misc_feature (79)..(79): Xaa can be any naturally occurring amino acid
  misc_feature (93)..(93): Xaa can be any naturally occurring amino acid
  misc_feature (105)..(105): Xaa can be any naturally occurring amino acid
  misc_feature (108)..(108): Xaa can be any naturally occurring amino acid
KLKLMYRCGXSMXCVVPXIXAFRXGWRWVRQPVQVPVTLVRNDGIIYSXSLTFTYTPXPGPRPHCSAAGAILRANSSQXPPNESNTNSEGSYXNASTNSTSVTSXTAXVVS

SEQ ID NO: 880 - protein, 96 aa, Homo sapiens
  misc_feature (6)..(6): Xaa can be any naturally occurring amino acid
  misc_feature (9)..(9): Xaa can be any naturally occurring amino acid
  misc_feature (12)..(13): Xaa can be any naturally occurring amino acid
  misc_feature (21)..(21): Xaa can be any naturally occurring amino acid
  misc_feature (24)..(24): Xaa can be any naturally occurring amino acid
  misc_feature (34)..(34): Xaa can be any naturally occurring amino acid
  misc_feature (40)..(40): Xaa can be any naturally occurring amino acid
  misc_feature (64)..(64): Xaa can be any naturally occurring amino acid
  misc_feature (68)..(68): Xaa can be any naturally occurring amino acid
  misc_feature (72)..(72): Xaa can be any naturally occurring amino acid
  misc_feature (74)..(74): Xaa can be any naturally occurring amino acid
  misc_feature (78)..(78): Xaa can be any naturally occurring amino acid
GQSILXIRXWAXXLPQSFLGXGKXPSVEWRGDVXMFELTXQNFTPNLRVWFGDVKAETYVQVWXEYAXCRPXHXCIPXRLEMGPATSPGSSNFGPK

SEQ ID NO: 881 - protein, 247 aa, Homo sapiens
  misc_feature (136)..(136): Xaa can be any naturally occurring amino acid
  misc_feature (234)..(234): Xaa can be any naturally occurring amino acid
  misc_feature (245)..(245): Xaa can be any naturally occurring amino acid
  misc_feature (247)..(247): Xaa can be any naturally occurring amino acid
TVFRQMRPVSRVLAPHLTRAYAKDVKFGADARALMLQGVDLLADAVAVTMGPKGRTVIIEQSWGSPKVTKDGVTVAKSIDLKDKYKNIGAKLVQDVANNTNEEAGDGTTTATVLARSIAKEGFEKISKGANPVEIXRGVMLAVDAVIAELKKQSKPVTTPEEIAQVATISANGDKEIGNIISDAMKKVGRKGVITVKDGKTLNDELEIIEGMKFDRGYISPYFINTSKGQKCEXQDAYVLVSEKXNX

SEQ ID NO: 882 - protein, 123 aa, Homo sapiens
  misc_feature (82)..(82): Xaa can be any naturally occurring amino acid
PRSNFMPSIISNSSFSVFPSFTVMTPFLPTFFIASEMILPISLSPFAEIVATCAISSGVVTGLDCFLSSAITASTANITPLXISTGLAPLLIFSKPSLAIERASTVAVVVPSPASSFVLLATS

SEQ ID NO: 883 - protein, 96 aa, Homo sapiens
  misc_feature (13)..(13): Xaa can be any naturally occurring amino acid
  misc_feature (31)..(31): Xaa can be any naturally occurring amino acid
  misc_feature (66)..(66): Xaa can be any naturally occurring amino acid
KKCRVLKDLLKSXRKIMQKFLQKVGYDAKGXRFCEYGEKGSFDPPKVVRTALLDAAGVASLLTTAXVVVTEIPKEEKDPGMGAMGGMGGGMGGGMF

SEQ ID NO: 884 - protein, 212 aa, Homo sapiens
  misc_feature (208)..(208): Xaa can be any naturally occurring amino acid
LAERTPCRRPAEMLRLPTVFRQMRPVSRVLAPHLTRAYAKDVKFGADARALMLQGVDLLADAVAVTMGPKGRTVIIEQSWGSPKVTKDGVTVAKSIDLKDKYKNIGAKLVQDVANNTNEEAGDGTTTATVLARSIAKEGFEKISKGANPVEIRRGVMLAVDAVIAELKKQSKPVTTPEEIAQVATISANGDKEIGNIISDAMKKVGRXGVIQ

SEQ ID NO: 885 - protein, 123 aa, Homo sapiens
  misc_feature (18)..(18): Xaa can be any naturally occurring amino acid
  misc_feature (26)..(26): Xaa can be any naturally occurring amino acid
GSKFNAFKNFLIHPFRVXPSFYWMTXFLPTFFIASEMILPISLSPFAEIVATCAISSGVVTGLDCFLSSAITASTANITPLLISTGLAPLLIFSKPSLAIERASTVAVVVPSPASSFVLLATS

SEQ ID NO: 886 - protein, 107 aa, Homo sapiens
TVTGSPRQCSSPITSEKSVGENEEKGWLKITITISYWFQLTKYIMVYCCHCPCLQIIYFVFLNKKHLYIPDTGYKSHVPVYCFQLKSLRHFYYYSVKIRILVLATTR

SEQ ID NO: 887 - protein, 107 aa, Homo sapiens
  misc_feature (105)..(105): Xaa can be any naturally occurring amino acid
TVTGSPRQCSSPITSEKSVGENEEKGWLKITITISYWFQLTKYIMVYCCHCPCLQIIYFVFLNKKHLYIPDTGYKSHVPVYCFQLKSLRHFYYYSVKIRILVLAXTR

SEQ ID NO: 888 - protein, 88 aa, Homo sapiens
  misc_feature (61)..(61): Xaa can be any naturally occurring amino acid
  misc_feature (68)..(68): Xaa can be any naturally occurring amino acid
  misc_feature (71)..(71): Xaa can be any naturally occurring amino acid
  misc_feature (76)..(76): Xaa can be any naturally occurring amino acid
  misc_feature (78)..(78): Xaa can be any naturally occurring amino acid
NMPPPIPPSIPPIAPIPGSFSSLGISVTTTSAVVNKRGPTQQHPIKAVLTTFGWGNDSFFXPYSPKIXPAXSIITXLXGGKLCINFLN

SEQ ID NO: 889 - protein, 107 aa, Homo sapiens; identical to SEQ ID NO: 886

SEQ ID NO: 890 - protein, 68 aa, Homo sapiens
  misc_feature (31)..(31): Xaa can be any naturally occurring amino acid
  misc_feature (58)..(58): Xaa can be any naturally occurring amino acid
STSLGVRTCHLPYHLPFHPLHPFQGPFSSFXNFWGLQLLLVVNREGPHQAAFPIKPVXHQPFGWGQRI

SEQ ID NO: 891 - protein, 107 aa, Homo sapiens; identical to SEQ ID NO: 886

SEQ ID NO: 892 - protein, 66 aa, Homo sapiens
  misc_feature (13)..(13): Xaa can be any naturally occurring amino acid
  misc_feature (29)..(29): Xaa can be any naturally occurring amino acid
DFGEYGEKGIIDXTKGCENCFYWMLLGVXSLLTTAEVVVTEIPKEEKDPGMGAMGGMGGGMGGGMF

SEQ ID NO: 893 - protein, 217 aa, Homo sapiens
MAMAYLAWRLARRSCPSSLQVTSFPVVQLHMNRTAMRASQKDFENSMNQVKLLKKDPGNEVKLKLYALYKQATEGPCNMPKPGVFDLINKAKWDAWNALGSLPKEAARQNYVDLVSSLSPSLESSSQVEPGTDRKSTGFETLVVTSEDGITKIMFNRPKKKNAINTEMYHEIMRALKAASKDDSIITVLTGNGDYYSSGNDLTNFTDIPPGGVEEKA

SEQ ID NO: 894 - protein, 156 aa, Homo sapiens
LQGGNGPAVGISVTLLGLFDAVYASDRATFHTPFSHLGQSPEGCSSYTFPKIMSPAKATEMLIFGKKLTAGEACAQGLVTEVFPDSTFQKEVWTRLKAFAKLPPNALRISKEVIRKREREKLHAVNAEECNVLQGRWLSDECTNAVVNFLSRKSKL

SEQ ID NO: 895 - protein, 195 aa, Homo sapiens
  misc_feature (172)..(173): Xaa can be any naturally occurring amino acid
  misc_feature (175)..(175): Xaa can be any naturally occurring amino acid
  misc_feature (188)..(188): Xaa can be any naturally occurring amino acid
VLGLETGAAFVSEVTSFPVVQLHMNRTAMRASQKDFENSMNQVKLLKKDPGNEVKLKLYALYKQATEGPCNMPKPGVFDLINKAKWDAWNALGSLPKEAARQNYVDLVSSLSPSLESSSQVEPGTDRKSTGFETLVVTSEDGITKIMFNRPKKKNAINTEMYHEIMRALKSXXQXMTQSSLVLTRKWXTITSKWE

SEQ ID NO: 896 - protein, 176 aa, Homo sapiens
  misc_feature (3)..(3): Xaa can be any naturally occurring amino acid
  misc_feature (8)..(8): Xaa can be any naturally occurring amino acid
  misc_feature (11)..(11): Xaa can be any naturally occurring amino acid
  misc_feature (32)..(32): Xaa can be any naturally occurring amino acid
  misc_feature (41)..(41): Xaa can be any naturally occurring amino acid
NNXVLLRXFVXCFIDFPKPLIAVVNGPAVGIXVTLLGLFDXVYASDRATFHTPFSHLGQSPEGCSSYTFPKIMSPAKATEMLIFGKKLTAGEACAQGLVTEVFPDSTFQKEVWTRLKAFAKLPPNALRISKEVIRKREREKLHAVNAEECNVLQGRWLSDECTNAVVNFLSRKSKL

SEQ ID NO: 897 - protein, 217 aa, Homo sapiens
  misc_feature (209)..(209): Xaa can be any naturally occurring amino acid
  misc_feature (214)..(214): Xaa can be any naturally occurring amino acid
MAMAYLAWRLARRSCPSSLQVTSFPVVQLHMNRTAMRASQKDFENSMNQVKLLKKDPGNEVKLKLYALYKQATEGPCNMPKPGVFDLINKAKWDAWNALGSLPKEAARQNYVDLVSSLSPSLESSSQVEPGTDRKSTGFETLVVTSEDGITKIMFNRPKKKNAINTEMYHEIMRALKAASKDDSIITVLTGNGDYYSSGNDLTNFTDIXPGGVXEKA

SEQ ID NO: 898 - protein, 158 aa, Homo sapiens
  misc_feature (4)..(4): Xaa can be any naturally occurring amino acid
  misc_feature (14)..(14): Xaa can be any naturally occurring amino acid
  misc_feature (23)..(23): Xaa can be any naturally occurring amino acid
  misc_feature (39)..(39): Xaa can be any naturally occurring amino acid
ASDXSGNGPAVGIXVTLLGLFDXVYASDRATFHTPFSHXGQSPEGCSSYTFPKIMSPAKATEMLIFGKKLTAGEACAQGLVTEVFPDSTFQKEVWTRLKAFAKLPPNALRISKEVIRKREREKLHAVNAEECNVLQGRWLSDECTNAVVNFLSRKSKL

SEQ ID NO: 899 - protein, 156 aa, Homo sapiens
LQWSMVQLWASPSPSLGLFDAVYASDRATFHTPFSHLGQSPEGCSSYTFPKIMSPAKATEMLIFGKKLTAGEACAQGLVTEVFPDSTFQKEVWTRLKAFAKLPPNALRISKEVIRKREREKLHAVNAEECNVLQGRWLSDECTNAVVNFLSRKSKL

SEQ ID NO: 900 - protein, 108 aa, Homo sapiens
  misc_feature (36)..(36): Xaa can be any naturally occurring amino acid
  misc_feature (85)..(85): Xaa can be any naturally occurring amino acid
LLKNHTDKQLSNKTGLVGFLACLTNMTDFLSQALLXKTSCGNQARDKNSSLMQLGERERLETSLASNSTHSHLCVSALLQAQYAXCRDGQMFRVGSGTFQPAKSAEVI

SEQ ID NO: 901 - protein, 77 aa, Homo sapiens
FYNALYLIKEFAFFVYTGMLYSLCILQGYKMSLILNITPKVISEKKGFLKLNLTFKKSYGQTTFKQNWISRISCLLN

SEQ ID NO: 902 - protein, 221 aa, Homo sapiens
  misc_feature (199)..(199): Xaa can be any naturally occurring amino acid
  misc_feature (212)..(212): Xaa can be any naturally occurring amino acid
  misc_feature (219)..(219): Xaa can be any naturally occurring amino acid
QNDDAEVSLMEVRFYVPPTQEDGVDPVEAFAQNVLSKADVIQATGDAICIFRELQCLTPRGRYDIRIYPTFLHLHGKTFDYKIPYTTVLRLFLLPHKDQRQMFFVISLDPPIKQGQTRYHFLILLFSKDEDISLTLNMNEEEVEKRFEGRLTKNMSGSLYEMVSRVMKALVNRKITVPGNFQGHSGAQCITCSYKAKLXTALPAGAGLHLRXQATCAHXLR

SEQ ID NO: 903 - protein, 170 aa, Homo sapiens
  misc_feature (5)..(5): Xaa can be any naturally occurring amino acid
  misc_feature (19)..(20): Xaa can be any naturally occurring amino acid
  misc_feature (35)..(35): Xaa can be any naturally occurring amino acid
  misc_feature (45)..(45): Xaa can be any naturally occurring amino acid
  misc_feature (49)..(49): Xaa can be any naturally occurring amino acid
  misc_feature (52)..(52): Xaa can be any naturally occurring amino acid
  misc_feature (55)..(55): Xaa can be any naturally occurring amino acid
  misc_feature (64)..(64): Xaa can be any naturally occurring amino acid
  misc_feature (83)..(83): Xaa can be any naturally occurring amino acid
  misc_feature (99)..(99): Xaa can be any naturally occurring amino acid
  misc_feature (111)..(112): Xaa can be any naturally occurring amino acid
  misc_feature (118)..(120): Xaa can be any naturally occurring amino acid
  misc_feature (123)..(123): Xaa can be any naturally occurring amino acid
  misc_feature (129)..(130): Xaa can be any naturally occurring amino acid
  misc_feature (133)..(133): Xaa can be any naturally occurring amino acid
  misc_feature (136)..(136): Xaa can be any naturally occurring amino acid
  misc_feature (148)..(148): Xaa can be any naturally occurring amino acid
  misc_feature (152)..(152): Xaa can be any naturally occurring amino acid
  misc_feature (154)..(154): Xaa can be any naturally occurring amino acid
  misc_feature (158)..(159): Xaa can be any naturally occurring amino acid
  misc_feature (161)..(161): Xaa can be any naturally occurring amino acid
  misc_feature (168)..(168): Xaa can be any naturally occurring amino acid
GRESXMRIWILHCPASHPXXPQIINSHPWEAAKLXRLPTALGTYXPTGXHVXMAXNPGTAFHEXKLVQNMGGESGGVKRQAQXEPSSVSTHRILTLKPXSWGEYWLVLLLXXPRSSSXXXCSXSLPEKXXSLXTNXLLFEALALTALXGRLXIXEPPXXGXGFLFPFXTL

SEQ ID NO: 904 - protein, 266 aa, Homo sapiens
  misc_feature (206)..(206): Xaa can be any naturally occurring amino acid
  misc_feature (219)..(219): Xaa can be any naturally occurring amino acid
  misc_feature (225)..(225): Xaa can be any naturally occurring amino acid
  misc_feature (235)..(235): Xaa can be any naturally occurring amino acid
  misc_feature (245)..(245): Xaa can be any naturally occurring amino acid
  misc_feature (251)..(251): Xaa can be any naturally occurring amino acid
  misc_feature (264)..(264): Xaa can be any naturally occurring amino acid
QSTVASGTVARVEPNIKWFGNTRVIKQSSLQKFQEEMDTVMKDPYKVVMKQSKLPMSLLHDRIRPHNLKVHILDTESFETTFGPKSQRKRPNLFASDMQSLIENAEMSTESYDQGKDRDLVTEDTGVRNEAQEEIYKKGQSKRIWGELYKVIDSSDVVVQVLDARDPMGTRSPHIETYLKKEKPWKHLIFVLNKCDLVPTWATKRXVAVLFQDYPTLAXHASLTXPFGKGAFIHXCGSFGKLPTXQENRSXVGSLAFPKVGKEXLG

SEQ ID NO: 905 - protein, 257 aa, Homo sapiens
  misc_feature (3)..(3): Xaa can be any naturally occurring amino acid
  misc_feature (5)..(5): Xaa can be any naturally occurring amino acid
  misc_feature (12)..(12): Xaa can be any naturally occurring amino acid
  misc_feature (19)..(20): Xaa can be any naturally occurring amino acid
  misc_feature (24)..(24): Xaa can be any naturally occurring amino acid
  misc_feature (29)..(29): Xaa can be any naturally occurring amino acid
  misc_feature (31)..(32): Xaa can be any naturally occurring amino acid
  misc_feature (34)..(35): Xaa can be any naturally occurring amino acid
  misc_feature (50)..(53): Xaa can be any naturally occurring amino acid
  misc_feature (55)..(56): Xaa can be any naturally occurring amino acid
  misc_feature (65)..(65): Xaa can be any naturally occurring amino acid
  misc_feature (72)..(72): Xaa can be any naturally occurring amino acid
  misc_feature (75)..(75): Xaa can be any naturally occurring amino acid
  misc_feature (80)..(80): Xaa can be any naturally occurring amino acid
  misc_feature (98)..(98): Xaa can be any naturally occurring amino acid
  misc_feature (102)..(102): Xaa can be any naturally occurring amino acid
  misc_feature (106)..(106): Xaa can be any naturally occurring amino acid
  misc_feature (119)..(119): Xaa can be any naturally occurring amino acid
  misc_feature (125)..(125): Xaa can be any naturally occurring amino acid
  misc_feature (166)..(168): Xaa can be any naturally occurring amino acid
  misc_feature (175)..(175): Xaa can be any naturally occurring amino acid
  misc_feature (187)..(187): Xaa can be any naturally occurring amino acid
  misc_feature (202)..(202): Xaa can be any naturally occurring amino acid
  misc_feature (224)..(224): Xaa can be any naturally occurring amino acid
  misc_feature (227)..(227): Xaa can be any naturally occurring amino acid
  misc_feature (248)..(249): Xaa can be any naturally occurring amino acid
GSXSXKTQPRPXPGGESPXXLQGXGSRFXPXXRXXKGPVPCVCLPQRCSXXXXEXXRTLVKSTWXLSFLGMXWFXWRCQXFEEELESFFDEEEEEQEXQRDXAEEXSSEPEEENVGNDXKAVIKXLDEKIAKYQKFLDKAKAKKFSAVRISKGLSEKIFAKPEEQXXXLEEDVDXRAPSKKGKKRKXQREEEQEHSNKAPRXLTSKERRRAVRQQRPKKVGVRXYEXPNVKNRNRNKKKTNDSEGQKXXRKKFRQKQ

SEQ ID NO: 906 - protein, 242 aa, Homo sapiens
  misc_feature (199)..(199): Xaa can be any naturally occurring amino acid
  misc_feature (240)..(240): Xaa can be any naturally occurring amino acid
AEKLRSVVMPMEKEIAALKDKLTEAEDKIKELEASKVKELNHYLEAEKSCRTDLEMYVAVLNTQKSVLQEDAEKLRKELHEVCHLLEQERQQHNQLKHTWQKANDQFLESQRLLMRDMQRMEIVLTSEQLRQVEELKKKDQEDDEQQRLNKRKDHKKADVEEEIKIPVVCALTQEESSAQLSNEEEHLDSTRGSVHSLXAGLLLPSGDPFSKSDNDMFKDGLRRAQSSRQLWDPRAHCNXKL

SEQ ID NO: 907 - protein, 84 aa, Homo sapiens
  misc_feature (9)..(11): Xaa can be any naturally occurring amino acid
  misc_feature (20)..(20): Xaa can be any naturally occurring amino acid
  misc_feature (22)..(22): Xaa can be any naturally occurring amino acid
  misc_feature (26)..(26): Xaa can be any naturally occurring amino acid
  misc_feature (28)..(28): Xaa can be any naturally occurring amino acid
  misc_feature (32)..(32): Xaa can be any naturally occurring amino acid
  misc_feature (34)..(34): Xaa can be any naturally occurring amino acid
  misc_feature (39)..(39): Xaa can be any naturally occurring amino acid
  misc_feature (43)..(43): Xaa can be any naturally occurring amino acid
  misc_feature (48)..(48): Xaa can be any naturally occurring amino acid
  misc_feature (50)..(50): Xaa can be any naturally occurring amino acid
  misc_feature (57)..(57): Xaa can be any naturally occurring amino acid
  misc_feature (61)..(62): Xaa can be any naturally occurring amino acid
  misc_feature (64)..(64): Xaa can be any naturally occurring amino acid
  misc_feature (69)..(69): Xaa can be any naturally occurring amino acid
  misc_feature (78)..(79): Xaa can be any naturally occurring amino acid
PSQIKVFFXXXGPPSKKFFXSXKKGXGXKKFXPXLGKGXGVSXGAKSXPXGNFLFWXKKPXXSXLSFVXPMCFGYKQXXVSLSR

SEQ ID NO: 908 - protein, 108 aa, Homo sapiens
  misc_feature (14)..(14): Xaa can be any naturally occurring amino acid
  misc_feature (16)..(16): Xaa can be any naturally occurring amino acid
  misc_feature (20)..(20): Xaa can be any naturally occurring amino acid
  misc_feature (39)..(40): Xaa can be any naturally occurring amino acid
  misc_feature (49)..(50): Xaa can be any naturally occurring amino acid
  misc_feature (54)..(54): Xaa can be any naturally occurring amino acid
  misc_feature (57)..(58): Xaa can be any naturally occurring amino acid
  misc_feature (61)..(61): Xaa can be any naturally occurring amino acid
  misc_feature (69)..(70): Xaa can be any naturally occurring amino acid
  misc_feature (76)..(76): Xaa can be any naturally occurring amino acid
  misc_feature (80)..(80): Xaa can be any naturally occurring amino acid
  misc_feature (85)..(85): Xaa can be any naturally occurring amino acid
  misc_feature (87)..(87): Xaa can be any naturally occurring amino acid
  misc_feature (91)..(92): Xaa can be any naturally occurring amino acid
  misc_feature (97)..(98): Xaa can be any naturally occurring amino acid
  misc_feature (108)..(108): Xaa can be any naturally occurring amino acid
NPTELFFCLKGLNXAXYIKXPFMLKTQLKELVSTWTGTXXFVYTQNTLXXQNLXSSXXVFXTKKGNSHXXGILPQXKPLXLSLNXGXIFLXXPLFFXXKKIFWKGAQX

SEQ ID NO: 909 - protein, 114 aa, Homo sapiens
  misc_feature (10)..(10): Xaa can be any naturally occurring amino acid
  misc_feature (13)..(13): Xaa can be any naturally occurring amino acid
  misc_feature (16)..(16): Xaa can be any naturally occurring amino acid
  misc_feature (36)..(37): Xaa can be any naturally occurring amino acid
  misc_feature (45)..(46): Xaa can be any naturally occurring amino acid
  misc_feature (50)..(50): Xaa can be any naturally occurring amino acid
  misc_feature (53)..(54): Xaa can be any naturally occurring amino acid
  misc_feature (57)..(57): Xaa can be any naturally occurring amino acid
  misc_feature (65)..(65): Xaa can be any naturally occurring amino acid
  misc_feature (67)..(67): Xaa can be any naturally occurring amino acid
  misc_feature (72)..(72): Xaa can be any naturally occurring amino acid
  misc_feature (76)..(76): Xaa can be any naturally occurring amino acid
  misc_feature (81)..(81): Xaa can be any naturally occurring amino acid
  misc_feature (83)..(83): Xaa can be any naturally occurring amino acid
  misc_feature (87)..(88): Xaa can be any naturally occurring amino acid
  misc_feature (93)..(94): Xaa can be any naturally occurring amino acid
  misc_feature (104)..(104): Xaa can be any naturally occurring amino acid
  misc_feature (106)..(106): Xaa can be any naturally occurring amino acid
AFLLPKRAKXCLXHQXPIYAENPIERIGFYLDRDTXXCLYPKHIXXTKLXKLXXGFXYQKRKFPXGXDFAPXETPXPFPKXGXNFFXXPPFFXXKKNFLEGGPXLXKKTFIWEG

SEQ ID NO: 910 - protein, 164 aa, Homo sapiens
KMAAPEKMTFPEKPSHKKYRAALKKEKRKKRRQELARLRDSGLSQKEEEEDTFIEEQQLEEEKLLERERQRLHEEWLLREQKAQEEFRIKKEKEEAAKKRQEEQERKLKEQWEEQQRKEREEEEQKRQEKKEKEEALQKMLDQAENELENGTTWQNPEPPWISE

SEQ ID NO: 911 - protein, 141 aa, Homo sapiens
SSIFCKASSFSFFSCRFCSSSSLSFLCCSSHCSFNFLSCSSCRFLAASSFSFFILNSSCAFCSLSNHSSCNLCLSLSNSFSSSSCCSSIKVSSSSSFCESPESLSRASSCRRFFRFSFFRAALYFLWLGFSGNVIFSGAAI

SEQ ID NO: 912 - protein, 184 aa, Homo sapiens
  misc_feature (11)..(11): Xaa can be any naturally occurring amino acid
  misc_feature (18)..(18): Xaa can be any naturally occurring amino acid
  misc_feature (20)..(20): Xaa can be any naturally occurring amino acid
  misc_feature (23)..(23): Xaa can be any naturally occurring amino acid
  misc_feature (31)..(32): Xaa can be any naturally occurring amino acid
  misc_feature (37)..(37): Xaa can be any naturally occurring amino acid
  misc_feature (40)..(40): Xaa can be any naturally occurring amino acid
  misc_feature (43)..(43): Xaa can be any naturally occurring amino acid
  misc_feature (46)..(46): Xaa can be any naturally occurring amino acid
  misc_feature (50)..(51): Xaa can be any naturally occurring amino acid
  misc_feature (55)..(55): Xaa can be any naturally occurring amino acid
  misc_feature (59)..(59): Xaa can be any naturally occurring amino acid
  misc_feature (67)..(67): Xaa can be any naturally occurring amino acid
  misc_feature (70)..(71): Xaa can be any naturally occurring amino acid
  misc_feature (73)..(73): Xaa can be any naturally occurring amino acid
  misc_feature (76)..(76): Xaa can be any naturally occurring amino acid
  misc_feature (78)..(78): Xaa can be any naturally occurring amino acid
  misc_feature (82)..(83): Xaa can be any naturally occurring amino acid
  misc_feature (85)..(85): Xaa can be any naturally occurring amino acid
  misc_feature (95)..(96): Xaa can be any naturally occurring amino acid
  misc_feature (101)..(102): Xaa can be any naturally occurring amino acid
  misc_feature (104)..(104): Xaa can be any naturally occurring amino acid
  misc_feature (107)..(107): Xaa can be any naturally occurring amino acid
  misc_feature (110)..(110): Xaa can be any naturally occurring amino acid
  misc_feature (112)..(112): Xaa can be any naturally occurring amino acid
  misc_feature (116)..(116): Xaa can be any naturally occurring amino acid
  misc_feature (126)..(126): Xaa can be any naturally occurring amino acid
  misc_feature (137)..(137): Xaa can be any naturally occurring amino acid
  misc_feature (139)..(139): Xaa can be any naturally occurring amino acid
  misc_feature (141)..(141): Xaa can be any naturally occurring amino acid
  misc_feature (143)..(143): Xaa can be any naturally occurring amino acid
  misc_feature (146)..(146): Xaa can be any naturally occurring amino acid
  misc_feature (149)..(149): Xaa can be any naturally occurring amino acid
  misc_feature (155)..(155): Xaa can be any naturally occurring amino acid
  misc_feature (158)..(160): Xaa can be any naturally occurring amino acid
  misc_feature (162)..(162): Xaa can be any naturally occurring amino acid
  misc_feature (165)..(165): Xaa can be any naturally occurring amino acid
  misc_feature (167)..(173): Xaa can be any naturally occurring amino acid
  misc_feature (175)..(175): Xaa can be any naturally occurring amino acid
  misc_feature (178)..(178): Xaa can be any naturally occurring amino acid
  misc_feature (182)..(182): Xaa can be any naturally occurring amino acid
PGEKWRFGFFXKPPNVQXEXPAXFFMGSEIXXIIFGXVIXTFXCFXIGLXXPLGXTPKXGKGWAPPXIFXXGXGEXKXLVQXXPXKKMGNPKGKXXVPGGXXFXNAXQKXGXGPIXEAKEKIGPPXGPPPGAGAPGXGXGXGXPGXPPXGAKVPXGPXXXAXGGXVXXXXXXXVXNPXKLVXFF

SEQ ID NO: 913 - protein, 181 aa, Homo sapiens
  misc_feature (8)..(8): Xaa can be any naturally occurring amino acid
  misc_feature (15)..(15): Xaa can be any naturally occurring amino acid
  misc_feature (17)..(17): Xaa can be any naturally occurring amino acid
  misc_feature (20)..(20): Xaa can be any naturally occurring amino acid
  misc_feature (29)..(29): Xaa can be any naturally occurring amino acid
  misc_feature (34)..(34): Xaa can be any naturally occurring amino acid
  misc_feature (37)..(38): Xaa can be any naturally occurring amino acid
  misc_feature (40)..(40): Xaa can be any naturally occurring amino acid
  misc_feature (44)..(44): Xaa can be any naturally occurring amino acid
  misc_feature (48)..(49): Xaa can be any naturally occurring amino acid
  misc_feature (52)..(52): Xaa can be any naturally occurring amino acid
  misc_feature (56)..(56): Xaa can be any naturally occurring amino acid
  misc_feature (64)..(64): Xaa can be any naturally occurring amino acid
  misc_feature (67)..(68): Xaa can be any naturally occurring amino acid
  misc_feature (71)..(71): Xaa can be any naturally occurring amino acid
  misc_feature (73)..(73): Xaa can be any naturally occurring amino acid
  misc_feature (75)..(75): Xaa can be any naturally occurring amino acid
  misc_feature (79)..(80): Xaa can be any naturally occurring amino acid
  misc_feature (82)..(82): Xaa can be any naturally occurring amino acid
  misc_feature (93)..(94): Xaa can be any naturally occurring amino acid
  misc_feature (98)..(99): Xaa can be any naturally occurring amino acid
  misc_feature (102)..(102): Xaa can be any naturally occurring amino acid
  misc_feature (104)..(104): Xaa can be any naturally occurring amino acid
  misc_feature (108)..(110): Xaa can be any naturally occurring amino acid
  misc_feature (113)..(113): Xaa can be any naturally occurring amino acid
  misc_feature (123)..(123): Xaa can be any naturally occurring amino acid
  misc_feature (134)..(134): Xaa can be any naturally occurring amino acid
  misc_feature (136)..(136): Xaa can be any naturally occurring amino acid
  misc_feature (138)..(138): Xaa can be any naturally occurring amino acid
  misc_feature (140)..(140): Xaa can be any naturally occurring amino acid
  misc_feature (143)..(143): Xaa can be any naturally occurring amino acid
  misc_feature (146)..(146): Xaa can be any naturally occurring amino acid
  misc_feature (153)..(153): Xaa can be any naturally occurring amino acid
  misc_feature (155)..(157): Xaa can be any naturally occurring amino acid
  misc_feature (159)..(159): Xaa can be any naturally occurring amino acid
  misc_feature (162)..(162): Xaa can be any naturally occurring amino acid
  misc_feature (164)..(164): Xaa can be any naturally occurring amino acid
  misc_feature (166)..(167): Xaa can be any naturally occurring amino acid
  misc_feature (169)..(170): Xaa can be any naturally occurring amino acid
  misc_feature (173)..(173): Xaa can be any naturally occurring amino acid
  misc_feature (176)..(176): Xaa can be any naturally occurring amino acid
  misc_feature (180)..(180): Xaa can be any naturally occurring amino acid
KMAIWVFXKTPQCPXGXPCXFFHGFRNPXNYFWXGNXXIXLFPXRTGXXFGXNSQXRERMGPPXDFXXRLXGXKXPSPXXSXKKNGESQRKSXXPRGXXFPXRXSKSXXXPNXRSKGKNRAPXRAPTRGRGTRXRXRXRXPRXPPXRSQSSFXSXXXGXRRXGXKXXTXXSPXSKXTSFXF

SEQ ID NO: 914 - protein, 114 aa, Homo sapiens
  misc_feature (2)..(2): Xaa can be any naturally occurring amino acid
  misc_feature (6)..(6): Xaa can be any naturally occurring amino acid
  misc_feature (9)..(9): Xaa can be any naturally occurring amino acid
  misc_feature (11)..(13): Xaa can be any naturally occurring amino acid
  misc_feature (15)..(17): Xaa can be any naturally occurring amino acid
  misc_feature (20)..(20): Xaa can be any naturally occurring amino acid
  misc_feature (22)..(22): Xaa can be any naturally occurring amino acid
  misc_feature (24)..(27): Xaa can be any naturally occurring amino acid
  misc_feature (29)..(29): Xaa can be any naturally occurring amino acid
  misc_feature (36)..(36): Xaa can be any naturally occurring amino acid
  misc_feature (39)..(39): Xaa can be any naturally occurring amino acid
  misc_feature (42)..(42): Xaa can be any naturally occurring amino acid
  misc_feature (44)..(44): Xaa can be any naturally occurring amino acid
  misc_feature (46)..(46): Xaa can be any naturally occurring amino acid
  misc_feature (48)..(48): Xaa can be any naturally occurring amino acid
  misc_feature (59)..(59): Xaa can be any naturally occurring amino acid
  misc_feature (69)..(69): Xaa can be any naturally occurring amino acid
  misc_feature (72)..(72): Xaa can be any naturally occurring amino acid
  misc_feature (74)..(74): Xaa can be any naturally occurring amino acid
  misc_feature (77)..(77): Xaa can be any naturally occurring amino acid
  misc_feature (80)..(80): Xaa can be any naturally occurring amino acid
  misc_feature (82)..(83): Xaa can be any naturally occurring amino acid
  misc_feature (88)..(89): Xaa can be any naturally occurring amino acid
  misc_feature (99)..(101): Xaa can be any naturally occurring amino acid
  misc_feature (103)..(103): Xaa can be any naturally occurring amino acid
  misc_feature (107)..(108): Xaa can be any naturally occurring amino acid
  misc_feature (111)..(111): Xaa can be any naturally occurring amino acid
  misc_feature (114)..(114): Xaa can be any naturally occurring amino acid
KXKLVXLDXGXXXVXXXLPXLXLXXXXDXKELWLRXGGXLGXRXRXRXRVPRPRVGALXGALFFPLLRXLGXSXLFXGRXGXXFPLGXXLFLWDSPFFXXXGXGLGXXLPXNLX

SEQ ID NO: 915 - protein, 202 aa, Homo sapiens
  misc_feature (5)..(5): Xaa can be any naturally occurring amino acid
PNLHXWESALMIWGSIEKEHDKLHEEIQNLIKIQAIAVCMENGNFKEAEEVFERIFGDPNSHMPFKSKLLMIISQKDTFHSFFQHFSYNHMMEKIKSYVNYVLSEKSSTFLMKAAAKVVESKRTRTITSQDKPSGNDVEMETEANLDTRKSVSDKQSAVTESSEGTVSLLRSHKNLFLSKLQHGTQQQDLNKKERRVGTPQS

SEQ ID NO: 916 - protein, 217 aa, Homo sapiens
LRKELERQAERLEKELASQQEKRAIEKDMMKKEITKEREYMGSKMLILSQNIAQLEAQVEKVTKEKISAINQLEEIQSQLASREMDVTKVCGEMRYQLNKTNMEKDEAEKEHREFRAKTNRDLEIKDQEIEKLRIELDESKQHLEQEQQKAALAREECLRLTELLGESEHQLHLTRQEKDSIQQSFSKEAKAQALQPSKESRSLPQKISKWNPPCKT

SEQ ID NO: 917 - protein, 107 aa, Homo sapiens
  misc_feature (7)..(7): Xaa can be any naturally occurring amino acid
  misc_feature (32)..(32): Xaa can be any naturally occurring amino acid
  misc_feature (52)..(52): Xaa can be any naturally occurring amino acid
  misc_feature (105)..(105): Xaa can be any naturally occurring amino acid
PKKLDQXSQKPRSEIAQLSQEKRYTYDKLGKXQRRNEELEEQCVQHGRVHEXMKQRLRQLDKHSQATAQQLVQLLSKQNQLLLERQSLSEEVDRLRTQLPSMPQXDC

SEQ ID NO: 918 - protein, 98 aa, Homo sapiens
  misc_feature (5)..(5): Xaa can be any naturally occurring amino acid
  misc_feature (25)..(25): Xaa can be any naturally occurring amino acid
  misc_feature (50)..(50): Xaa can be any naturally occurring amino acid
  misc_feature (59)..(59): Xaa can be any naturally occurring amino acid
  misc_feature (74)..(74): Xaa can be any naturally occurring amino acid
  misc_feature (84)..(84): Xaa can be any naturally occurring amino acid
  misc_feature (97)..(97): Xaa can be any naturally occurring amino acid
PLLHXLMYSPMLDTLFLQFFISSLXLSQFIICIPFFLTELSYFRSGFLRXLVQFLGLMXNILPLTFVKNVFLGXQQQNTGHFQXWHAGLSFAGIFWXT

SEQ ID NO: 919 - protein, 98 aa, Homo sapiens
  misc_feature (14)..(14): Xaa can be any naturally occurring amino acid
  misc_feature (67)..(67): Xaa can be any naturally occurring amino acid
  misc_feature (86)..(86): Xaa can be any naturally occurring amino acid
IIYFTLFHPGQQSXCGMLGNWVRSRSTSSDRLCLSRRSWFCLLRSCTSCWAVAWLCLSSCLSLCFIXSCTLPCWTHCSSNSSFLLXNFPNLSYVYLFS

SEQ ID NO: 920 - protein, 236 aa, Homo sapiens
  misc_feature (218)..(218): Xaa can be any naturally occurring amino acid
  misc_feature (225)..(225): Xaa can be any naturally occurring amino acid
  misc_feature (231)..(231): Xaa can be any naturally occurring amino acid
QTHTNVHMQTIERLVKERDDLMSALVSVRSSLADTQQREASAYEQVKQVLQISEEANFEKTKALIQCDQLRKELERQAERLEKELASQQEKRAIEKDMMKKEITKEREYMGSKMLILSQNIAQLEAQVEKVTKEKISAINQLEEIQSQLASREMDVTKVCGEMRYQLNKTNMEKDEAEKEHREFRAKTNRDLEIKDQEIEKLRIELDESKHTWNRSSXRHPGQKXVPETNXTAGRI

SEQ ID NO: 921 - protein, 112 aa, Homo sapiens
  misc_feature (8)..(8): Xaa can be any naturally occurring amino acid
  misc_feature (19)..(19): Xaa can be any naturally occurring amino acid
  misc_feature (25)..(25): Xaa can be any naturally occurring amino acid
  misc_feature (32)..(32): Xaa can be any naturally occurring amino acid
MYLFPVWXRAVGSDSPSSXVSLRHXFLARVPXAAPVPSVFAFIQFYSQFLYFLIFNFKIPVSFCSELSVLLFCLILLHVGFIQLIAHFSTHLCDIHFPRSQLALNFLQLINS

SEQ ID NO: 922 - protein, 186 aa, Homo sapiens
  misc_feature (2)..(2): Xaa can be any naturally occurring amino acid
  misc_feature (7)..(7): Xaa can be any naturally occurring amino acid
  misc_feature (9)..(11): Xaa can be any naturally occurring amino acid
  misc_feature (20)..(20): Xaa can be any naturally occurring amino acid
  misc_feature (22)..(22): Xaa can be any naturally occurring amino acid
  misc_feature (24)..(24): Xaa can be any naturally occurring amino acid
  misc_feature (32)..(32): Xaa can be any naturally occurring amino acid
  misc_feature (37)..(37): Xaa can be any naturally occurring amino acid
  misc_feature (42)..(42): Xaa can be any naturally occurring amino acid
  misc_feature (45)..(45): Xaa can be any naturally occurring amino acid
  misc_feature (55)..(55): Xaa can be any naturally occurring amino acid
  misc_feature (61)..(61): Xaa can be any naturally occurring amino acid
  misc_feature (64)..(64): Xaa can be any naturally occurring amino acid
  misc_feature (86)..(86): Xaa can be any naturally occurring amino acid
  misc_feature (111)..(111): Xaa can be any naturally occurring amino acid
LXGDFEXQXXXPQQEKVSFXQXFXKEERPKPXRPRKXSRSCXRNXANGSPACQNXKMTSFXCCXPRIHFCKVKERMLYISQETGPXSQKTRFEIAQLSQEKRYTYDKLGKXQRRNEELEEQCVQHGRVHETMKQRLRQLDKHSQATAQQLVQLLSKQNQLLLERQSLSEEVDRLRTQLPSMPQSDC

SEQ ID NO: 923 - protein, 135 aa, Homo sapiens
  misc_feature (25)..(25): Xaa can be any naturally occurring amino acid
  misc_feature (50)..(50): Xaa can be any naturally occurring amino acid
  misc_feature (72)..(72): Xaa can be any naturally occurring amino acid
  misc_feature (75)..(75): Xaa can be any naturally occurring amino acid
  misc_feature (81)..(81): Xaa can be any naturally occurring amino acid
  misc_feature (91)..(91): Xaa can be any naturally occurring amino acid
  misc_feature (94)..(94): Xaa can be any naturally occurring amino acid
  misc_feature (99)..(99): Xaa can be any naturally occurring amino acid
  misc_feature (104)..(104): Xaa can be any naturally occurring amino acid
  misc_feature (112)..(112): Xaa can be any naturally occurring amino acid
  misc_feature (114)..(114): Xaa can be any naturally occurring amino acid
  misc_feature (116)..(116): Xaa can be any naturally occurring amino acid
  misc_feature (125)..(127): Xaa can be any naturally occurring amino acid
  misc_feature (129)..(129): Xaa can be any naturally occurring amino acid
  misc_feature (134)..(134): Xaa can be any naturally occurring amino acid
PLLHRLMYSPMLDTLFLQFFISSLXLSQFIICIPFFLTELSYFKSGFLRXWSSFLANVQHSFFNFAKMYSGXATXKTGHFXVLACWASICXISXATPAXFSWPXRLGPFFLXKXLXKANFFLLGXXXLXLKIPXQ

SEQ ID NO: 924 - protein, 159 aa, Homo sapiens
  misc_feature (31)..(31): Xaa can be any naturally occurring amino acid
ADREGGCAAGRGRELEPELEPGPGPGSALEXGEEFEIVDRSQLPGPGDLRSATRPRAAEGWSAPILTLARRATGNLSASCGSALRAAAGLGGGDSGDGTARAASKCQMMEERANLMHMMKLSIKVLLQSALSLGRSLDADHAPLQQFFCSDGALPQTWA

SEQ ID NO: 925 - protein, 154 aa, Homo sapiens
  misc_feature (124)..(124): Xaa can be any naturally occurring amino acid
GSAPSLQKNCCKGAWSASRLRPRLRADWSNTLMLSFIMCIRLARSSIIWHLEAARAVPSPLSPPPSPAAARSALPQLADRFPVALRARVRMGADQPSAARGLVALRRSPGPGSWLRSTISNSSXGSSADPGPGPGSSSGSSSRPRPAAQPPSRS

SEQ ID NO: 926 - protein, 134 aa, Homo sapiens
  misc_feature (131)..(131): Xaa can be any naturally occurring amino acid
LSSPCLRQCSITTKELLQGGMVRIQAAAQAQSRLEQHLDAEFHHVHQVGTLLHHLALRSCARRAVPAVPAAQPRGRAQRAPAARRQVPGGPACQGQDGRRPALGRPRPRCAPQVAWAGQLASVHDLKLFSXLKR

SEQ ID NO: 927 - protein, 424 aa, Homo sapiens
  misc_feature (408)..(408): Xaa can be any naturally occurring amino acid
  misc_feature (423)..(423): Xaa can be any naturally occurring amino acid
IRYLEVLCTKKVSEKMEFFNISVDNTCSLFRGLQKEEVVLLTHGDSVDKVADGFKVVARSGNIVAGIANESKKLYGAQFHPEVGLTENGKVILKNFLYDITGCSGTFTVQNRELECIREIKERVGTSKVLVLLSGGVDSTVCTALLNRALNQEQVIAVHIDNGFMRKRESQSVEEALKKLGIQVKVINAAHSFYNGTTTLPISDEDRTPRKRISKTLNMTTSPEEKRKIIGDTFVKIANEVIGEMNLKPEEVFLAQGTLRPDLIESASLVASGKAELIKTHHNDTELIKKLREEGKVIEPLKDFHKDEVRILGRELGLPEELVSRHPFPGPGLAIRVICAEEPYICKDFPETNNILKIVADFSASVKKPHTLLQRVKACTTEEDQEKLMQITSLHSLNAFLLPIKTVXVQGDCRSYSYRVWNXQ

SEQ ID NO: 928 - protein, 191 aa, Homo sapiens
PRSAAVAPFGAFLAAGSSPLPAAPRPGLLLNLSPRRRPFRHPPAPSRTVAVTAAAPALAPMALCNGDSKLENAGGDLKDGHHHYEGAVVILDAGAQYGKVIDRRVRELFVQSEIFPLETPAFAIKEQGFRAIIISGGPNSVYAEDAPWFDPTIFTIGKPVLGICYGMQMMNKVFGGTVHKKSVRKDGVFQH

SEQ ID NO: 929 - protein, 203 aa, Homo sapiens
RPLNNEHVLSTLMLKNSIFSDTFFVHSTSKYLIHHLHTIANSKNRLANSEYCWIKPGSIFSIHRIRSSRDDNSTESLFLYSKCWCFQGENFRLHEQFPHSSVYDFPVLSTSIQNDNSSFIVVVAILKVSSSILQLGVSVAQSHRGQGRSRGGDGDSTRRGGRVPEGSAPRAEVEKEAWSRSSRQRRGASRQKSAEWSNSSGAR

SEQ ID NO: 930 - protein, 236 aa, Homo sapiens
  misc_feature (168)..(168): Xaa can be any naturally occurring amino acid
  misc_feature (172)..(172): Xaa can be any naturally occurring amino acid
  misc_feature (194)..(194): Xaa can be any naturally occurring amino acid
  misc_feature (202)..(202): Xaa can be any naturally occurring amino acid
  misc_feature (205)..(205): Xaa can be any naturally occurring amino acid
  misc_feature (227)..(227): Xaa can be any naturally occurring amino acid
  misc_feature (235)..(235): Xaa can be any naturally occurring amino acid
PRSAAVAPFGAFLAAGSSPLPAAPRPGLLLNLSPRRRPFRHPPAPSRTVAVTAAAPALAPMALCNGDSKLENAGGDLKDGHHHYEGAVVILDAGAQYGKVIDRRVRELFVQSEIFPLETPAFAIKEQGFRAIIISGGPNSVYAEDAPWFDPTIFTIGKPVLGICYGMXMMNXVFGGTVHKKKCQKRWSFSTLVXIIHVHYSXAFXKEKLVLAYTWENSVKQSNLMEXKVGAPFWXK

SEQ ID NO: 931 - protein, 189 aa, Homo sapiens
  misc_feature (18)..(18): Xaa can be any naturally occurring amino acid
  misc_feature (22)..(22): Xaa can be any naturally occurring amino acid
KTPSFLTLFFVHSTSKYXIHHXHTIANSKNRLANSEYCWIKPGSIFSIHRIRSSRDDNSTESLFLYSKCWCFQGENFRLHEQFPHSSVYDFPVLSTSIQNDNSSFIVVVAILKVSSSILQLGVSVAQSHRGQGRSRGGDGDSTRRGGRVPEGSAPRAEVEKEAWSRSSRQRRGASRQKSAEWSNSSGAR

SEQ ID NO: 932 - protein, 175 aa, Homo sapiens
  misc_feature (13)..(14): Xaa can be any naturally occurring amino acid
  misc_feature (21)..(21): Xaa can be any naturally occurring amino acid
  misc_feature (24)..(24): Xaa can be any naturally occurring amino acid
  misc_feature (26)..(26): Xaa can be any naturally occurring amino acid
  misc_feature (28)..(29): Xaa can be any naturally occurring amino acid
  misc_feature (32)..(32): Xaa can be any naturally occurring amino acid
  misc_feature (41)..(41): Xaa can be any naturally occurring amino acid
  misc_feature (48)..(48): Xaa can be any naturally occurring amino acid
  misc_feature (52)..(52): Xaa can be any naturally occurring amino acid
  misc_feature (54)..(54): Xaa can be any naturally occurring amino acid
  misc_feature (56)..(56): Xaa can be any naturally occurring amino acid
  misc_feature (66)..(66): Xaa can be any naturally occurring amino acid
  misc_feature (73)..(73): Xaa can be any naturally occurring amino acid
  misc_feature (76)..(76): Xaa can be any naturally occurring amino acid
  misc_feature (87)..(87): Xaa can be any naturally occurring amino acid
  misc_feature (91)..(91): Xaa can be any naturally occurring amino acid
  misc_feature (93)..(93): Xaa can be any naturally occurring amino acid
  misc_feature (95)..(95): Xaa can be any naturally occurring amino acid
  misc_feature (98)..(98): Xaa can be any naturally occurring amino acid
  misc_feature (104)..(106): Xaa can be any naturally occurring amino acid
  misc_feature (109)..(109): Xaa can be any naturally occurring amino acid
  misc_feature (112)..(112): Xaa can be any naturally occurring amino acid
  misc_feature (114)..(114): Xaa can be any naturally occurring amino acid
  misc_feature (117)..(117): Xaa can be any naturally occurring amino acid
  misc_feature (121)..(121): Xaa can be any naturally occurring amino acid
  misc_feature (124)..(125): Xaa can be any naturally occurring amino acid
  misc_feature (130)..(131): Xaa can be any naturally occurring amino acid
  misc_feature (134)..(134): Xaa can be any naturally occurring amino acid
  misc_feature (143)..(143): Xaa can be any naturally occurring amino acid
  misc_feature (146)..(146): Xaa can be any naturally occurring amino acid
  misc_feature (149)..(150): Xaa can be any naturally occurring amino acid
  misc_feature (152)..(153): Xaa can be any naturally occurring amino acid
  misc_feature (156)..(156): Xaa can be any naturally occurring amino acid
  misc_feature (158)..(158): Xaa can be any naturally occurring amino acid
  misc_feature (172)..(172): Xaa can be any naturally occurring amino acid
  misc_feature (174)..(175): Xaa can be any naturally occurring amino acid
VCRGLWFPQLGGXXSSKNDPXWEXLXFXXRLXPGMCHNVNXVVYIFGXPVKXPXTXVTPPFLTTGXVSTLRQXDFXAHNIFREFGYXGKIXQXPXILXPLHFDXXXLQXQPXCXRFXVIRXFIXXDFMTXXPAXPGNEIPVKXVLXMVXXIXXIPXIXRIMYDLTSKPPGTXEXX

SEQ ID NO: 933 - protein, 202 aa, Homo sapiens
  misc_feature (190)..(190): Xaa can be any naturally occurring amino acid
  misc_feature (200)..(200): Xaa can be any naturally occurring amino acid
GNIVAGIANESKKLYGAQFHPEVGLTENGKVILKNFLYDIAGCSGTFTVQNRELECIREIKERVGTSKVLVLLSGGVDSTVCTALLNRALNQEQVIAVHIDNGFMRKRESQSVEEALKKLGIQVKVINAAHSFYNGTTTLPISDEDRTPRKRISKTLNMTTSPEEKRKIIGDTFVKIANEVIGEMNLKPXEVFLAQGLYXLI

SEQ ID NO: 934 - protein, 152 aa, Homo sapiens
  misc_feature (3)..(3): Xaa can be any naturally occurring amino acid
  misc_feature (6)..(6): Xaa can be any naturally occurring amino acid
  misc_feature (15)..(15): Xaa can be any naturally occurring amino acid
  misc_feature (17)..(17): Xaa can be any naturally occurring amino acid
  misc_feature (30)..(30): Xaa can be any naturally occurring amino acid
  misc_feature (36)..(36): Xaa can be any naturally occurring amino acid
  misc_feature (47)..(48): Xaa can be any naturally occurring amino acid
  misc_feature (54)..(54): Xaa can be any naturally occurring amino acid
  misc_feature (69)..(69): Xaa can be any naturally occurring amino acid
  misc_feature (76)..(77): Xaa can be any naturally occurring amino acid
  misc_feature (85)..(85): Xaa can be any naturally occurring amino acid
  misc_feature (102)..(102): Xaa can be any naturally occurring amino acid
  misc_feature (110)..(110): Xaa can be any naturally occurring amino acid
  misc_feature (120)..(120): Xaa can be any naturally occurring amino acid
PAXYFXKKMVGFKKXPXPKKKVFSSTYYFXIAQAQXPGKWKAWKTNXXWKVQVXWPKNSHFIFNEIFPXVLITFPXXSQLFDELXVIVMGFDESSFATCNKXWHFQLDQXVKTLGKENLXWFQVHFSNYFIGNLNKSIPNDFSFLFRTCGHI

SEQ ID NO: 935 - protein, 176 aa, Homo sapiens
VCRVTVVPTVTCVESPVKMNLTGNHFIFLARLIPRMCHNVNRVVYIFGPPVKEPPTDVTPTFLTTGVLSTLRQADFEAHNILRESGYAGKISQMPVILTPLHFDRDPLQKQPSCQRSVVIRTFITSDFMTGIPATPGNEIPVEVVLKMVTEIKKIPGISRIMYDLTSKPPGTTEWE

SEQ ID NO: 936 - protein, 218 aa, Homo sapiens
  misc_feature (202)..(202): Xaa can be any naturally occurring amino acid
  misc_feature (217)..(217): Xaa can be any naturally occurring amino acid
RTPRKRISKTLNMTTSPEEKRKIIGDTFVKIANEVIGEMNLKPEEVFLAQGTLRPDLIESASLVASGKAELIKTHHNDTELIRKLREEGKVIEPLKDFHKDEVRILGRELGLPEELVSRHPFPGPGLAIRVICAEEPYICKDFPETNNILKIVADFSASVKKPHTLLQRVKACTTEEDQEKLMQITSLHSLNAFLLPIKTVXVQGDCRSYSYRVWNXQ

SEQ ID NO: 937 - protein, 246 aa, Homo sapiens
  misc_feature (229)..(229): Xaa can be any naturally occurring amino acid
  misc_feature (236)..(237): Xaa can be any naturally occurring amino acid
  misc_feature (244)..(244): Xaa can be any naturally occurring amino acid
AAAPALAPMALCNGDSKLENAGGDLKDGHHHYEGAVVILDAGAQYGKVIDRRVRELFVQSEIFPLETPAFAIKEQGFRAIIISGGPNSVYAEDAPWFDPAIFTIGKPVLGICYGMQMMNKVFGGTVHKKSVREDGVFNISVDNTCSLFRGLQKEEVVLLTHGDSVDKVADGFKVVARSGNIVAGIANESKKLYGAQFHPEVGLTENGKVILKNFLYDITWMQWNLHRAXTEKLECXXEIKRESXAR

SEQ ID NO: 938 - protein, 145 aa, Homo sapiens
TCIIHTNVENSIFSDTFFVHSTSKYLIHHLHTIANSKNRLANSEYCWIKPGSIFSIHRIRSSRDDNSTESLFLYSKCWCFQGENFRLHEQFPHSSVYDFPVLSTSIQNDNSSFIVVVAILKVSSSILQLGVSVAQSHRGQGRSRG

SEQ ID NO: 939 - protein, 220 aa, Homo sapiens
  misc_feature (211)..(211): Xaa can be any naturally occurring amino acid
TMEAKDQKKHRKKNSGPKAAKKKKRLLQDLQLGDEEDARKRNPKAFAVQSAVRMARSFHRTQDLKTKKHHIPVVDRTPLEPPPIVVVVMGPPKVGKSTLIQCLIRNFTRQKLTEIRGPVTIVSGKKRRLTIIECGCDINMMIDLAKVADLVLMLIDASFGFEMETFEFLNICQVHGFPKIMGVLTHLDFFKHNKPTGGRQRSRLKHRFWTXKFTPGAQAV

SEQ ID NO: 940 - protein, 156 aa, Homo sapiens
  misc_feature (131)..(131): Xaa can be any naturally occurring amino acid
  misc_feature (137)..(137): Xaa can be any naturally occurring amino acid
  misc_feature (150)..(150): Xaa can be any naturally occurring amino acid
  misc_feature (155)..(155): Xaa can be any naturally occurring amino acid
NCLPPQIQGQSLQSKGSLQLALSPLQTGLLVSSFLLPLNSEELLPEVLLPLQLLLLLLLLGSEVLFIVQVPLLLGLLHLLTMHRTQSIQQCKDLSFMRLAYDGRSPPVLWHLACLCLGLGLVLKWQGLLQXFWNVQXIKMFLLPQDGLYXKVLGXL

SEQ ID NO: 941 - protein, 132 aa, Homo sapiens
  misc_feature (5)..(5): Xaa can be any naturally occurring amino acid
  misc_feature (10)..(10): Xaa can be any naturally occurring amino acid
  misc_feature (12)..(12): Xaa can be any naturally occurring amino acid
  misc_feature (16)..(16): Xaa can be any naturally occurring amino acid
  misc_feature (19)..(19): Xaa can be any naturally occurring amino acid
  misc_feature (21)..(21): Xaa can be any naturally occurring amino acid
  misc_feature (23)..(23): Xaa can be any naturally occurring amino acid
  misc_feature (26)..(26): Xaa can be any naturally occurring amino acid
  misc_feature (47)..(47): Xaa can be any naturally occurring amino acid
  misc_feature (55)..(55): Xaa can be any naturally occurring amino acid
  misc_feature (80)..(80): Xaa can be any naturally occurring amino acid
  misc_feature (82)..(82): Xaa can be any naturally occurring amino acid
  misc_feature (131)..(131): Xaa can be any naturally occurring amino acid
GQKEXFLISXAXSQNXLPXGXSXFKXQAQAPNQKAGKVPKGQAEPGXHTRAFMKXRSLALLDALSTVHSQKMKKAKEQRXLXNKEPFRAKQKEEEEKLKRQKDLRKKLFRIQGQKERRNQKSSLKGAEGQXQ

SEQ ID NO: 942 - protein, 142 aa, Homo sapiens
  misc_feature (6)..(6): Xaa can be any naturally occurring amino acid
  misc_feature (19)..(19): Xaa can be any naturally occurring amino acid
  misc_feature (68)..(68): Xaa can be any naturally occurring amino acid
  misc_feature (70)..(70): Xaa can be any naturally occurring amino acid
  misc_feature (95)..(95): Xaa can be any naturally occurring amino acid
  misc_feature (103)..(103): Xaa can be any naturally occurring amino acid
  misc_feature (124)..(124): Xaa can be any naturally occurring amino acid
  misc_feature (127)..(127): Xaa can be any naturally occurring amino acid
  misc_feature (129)..(129): Xaa can be any naturally occurring amino acid
  misc_feature (131)..(131): Xaa can be any naturally occurring amino acid
  misc_feature (134)..(134): Xaa can be any naturally occurring amino acid
  misc_feature (138)..(138): Xaa can be any naturally occurring amino acid
  misc_feature (140)..(140): Xaa can be any naturally occurring amino acid
NCLPPXIQGQSLQSKGSLXLALSPLQTGLLVSSFLLPLNSEELLPEVLLPLQLLLLLLLLGSEGLFIXQXPLLLGLLHLLTMHRTQSIQQCKGSXFHEGSRMXAGLRLSFWHLACLLVWGLGLXLKXGXAXWQXVLGXGXGN

SEQ ID NO: 943 - protein, 127 aa, Homo sapiens
  misc_feature (10)..(10): Xaa can be any naturally occurring amino acid
  misc_feature (14)..(15): Xaa can be any naturally occurring amino acid
  misc_feature (17)..(17): Xaa can be any naturally occurring amino acid
  misc_feature (19)..(20): Xaa can be any naturally occurring amino acid
  misc_feature (22)..(22): Xaa can be any naturally occurring amino acid
AKRNLFNSLXHSQXXCXRXXHXRPSPSPSKGRQGAKDRRRPAVIREPHERKILALLDALSTVHSQKMKKAKEQRHLHNKEHFRAKQKEEEEKLKRQKDLRKKLFRIQGQKERRNQKSSLKGAEGQLQ

SEQ ID NO: 944 - protein, 159 aa, Homo sapiens
  misc_feature (123)..(123): Xaa can be any naturally occurring amino acid
  misc_feature (125)..(126): Xaa can be any naturally occurring amino acid
  misc_feature (128)..(128): Xaa can be any naturally occurring amino acid
  misc_feature (130)..(131): Xaa can be any naturally occurring amino acid
  misc_feature (135)..(135): Xaa can be any naturally occurring amino acid
  misc_feature (152)..(152): Xaa can be any naturally occurring amino acid
  misc_feature (159)..(159): Xaa can be any naturally occurring amino acid
NCLPPQIQGQSLQSKGSLQLALSPLQTGLLVSSFLLPLNSEELLPEVLLPLQLLLLLLLLGSEVLFIVQVPLLLGLLHLLTMHRTQSIQQCKDLSFMRLAYDGRSPPVFGTLPAFAWAWAWSXMXXPXAXXLGMXKGIKKVSFGLRIGLFKXVLGRLLX

SEQ ID NO: 945 - protein, 250 aa, Homo sapiens
  misc_feature (188)..(188): Xaa can be any naturally occurring amino acid
  misc_feature (216)..(216): Xaa can be any naturally occurring amino acid
  misc_feature (229)..(229): Xaa can be any naturally occurring amino acid
  misc_feature (244)..(244): Xaa can be any naturally occurring amino acid
INYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKGFIRISCCQYCKIEFHMNCWKKLKTTTFNDKIDKDFLQGICLTPDCEXVISKIIIFSSGGEVKCEFEHKVIKEKVXSRPILKQKCSSLXKLRLEEDKKLEEKGXQKKEPK

SEQ ID NO: 946 - protein, 128 aa, Homo sapiens
  misc_feature (21)..(21): Xaa can be any naturally occurring amino acid
  misc_feature (63)..(63): Xaa can be any naturally occurring amino acid
  misc_feature (110)..(112): Xaa can be any naturally occurring amino acid
  misc_feature (123)..(123): Xaa can be any naturally occurring amino acid
RASNSSTSCRRWSGTANGPAXSEFRLLWSSLEVMISLFEVTEVVPDPTNIGFESFGFFFLLLXFTLVELNGASPLSCFLNTVQAGVHYIKRIHLKHYAMLGNLGFWGLLXXXILNKPGLSFKXKPGLP

SEQ ID NO: 947 - protein, 127 aa, Homo sapiens
  misc_feature (115)..(115): Xaa can be any naturally occurring amino acid
AVMQPSSVQYSCQSQQNEGIPREKVLNLLLFLVSVEFLLGKTHILQRTSCYSCPRDHVPPKTERSNHIELNIFVLGSCPIASYCGQHIRYCVGHRELRILLHLAEDGQALQMGLXNLNFDCYGLHLK

SEQ ID NO: 948 - protein, 183 aa, Homo sapiens
  misc_feature (25)..(25): Xaa can be any naturally occurring amino acid
  misc_feature (67)..(67): Xaa can be any naturally occurring amino acid
WTPACTVLRKQDSGEAPFSSTKVKXKSKKKKPKDSKPMLVGSGTTSVTSNNEIITSSEDHSNRNSDXAGPFAVPDHLRQDVEEFEALYDQHSNEYVVRNKKLWDMNPKQKCSTLYDYFSQFLEEHGPLDMSNKMFSAEYEFFPEETRQILEKAGGLKPFLLGCPRFVVIDNCIALKKVASRLK

SEQ ID NO: 949 - protein, 219 aa, Homo sapiens
  misc_feature (205)..(205): Xaa can be any naturally occurring amino acid
  misc_feature (210)..(210): Xaa can be any naturally occurring amino acid
LLNGLDPQKIKQLNLAMINYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKGFIRISCCQYCKIEFHMNCWKKLKTTTFNDKIDKGFSTREYVLPLTVXGSFLXIIIFSSGWV

SEQ ID NO: 950 - protein, 116 aa, Homo sapiens
  misc_feature (71)..(71): Xaa can be any naturally occurring amino acid
RASNSSTSCRRWSGTANGPAESEFRLLWSSLEVMISLFEVTEVVPDPTNIGFESFGFFFLLLFFTLVELNXASPLSCFLNTVQRVPLYQRIHLKHYAMLGNLALGSSSTILNNGFL

SEQ ID NO: 951 - protein, 127 aa, Homo sapiens
AVMQPSSVQYSCQSQQNEGIPREKVLNLLLFLVSVEFLLGKTHILQRTSCYSCPRDHVPPKTERSNHIELNIFVLGSCPIASYCGQHIRYCVGHRELRILLHLAEDGQALQMGLQNLNFDCYGLHLK

SEQ ID NO: 952 - protein, 184 aa, Homo sapiens
  misc_feature (17)..(17): Xaa can be any naturally occurring amino acid
YNGTRCTVLRKQDSGEXPFSSTKVKNKSKKKKPKDSKPMLVGSGTTSVTSNNEIITSSEDHSNRNSDSAGPFAVPDHLRQDVEEFEALYDQHSNEYVVRNKKLWDMNPKQKCSTLYDYFSQFLEEHGPLDMSNKMFSAEYEFFPEETRQILEKAGGLKPFLLGCPRFVVIDNCIALKKVASRLK

SEQ ID NO: 953 - protein, 185 aa, Homo sapiens
  misc_feature (3)..(4): Xaa can be any naturally occurring amino acid
  misc_feature (18)..(18): Xaa can be any naturally occurring amino acid
YNXXPLVLVLRKQDSGEXPFSSTKVKNKSKKKKPKDSKPMLVGSGTTSVTSNNEIITSSEDHSNRNSDSAGPFAVPDHLRQDVEEFEALYDQHSNEYVVRNKKLWDMNPKQKCSTLYDYFSQFLEEHGPLDMSNKMFSAEYEFFPEETRQILEKAGGLKPFLLGCPRFVVIDNCIALKKVASRLK

SEQ ID NO: 954 - protein, 125 aa, Homo sapiens
MQPSSVQYSCQSQQNEGIPREKVLNLLLFLVSVEFLLGKTHILQRTSCYSCPRDHVPPKTERSNHIELNIFVLGSCPIASYCGQHIRYCVGHRELRILLHLAEDGQALQMGLQNLNFDCYGLHLK

SEQ ID NO: 955 - protein, 212 aa, Homo sapiens
EDEKRRRKEEEERRMKLEMEAKRKQEEEERKKREDDEKRIQAEVEAQLARQKEEESQQQAVLEQERRDRELALRIAQSEAELISDEAQADLALRSLDSYPVTSKNDGTRPKMTPEQMAKEMSEFLSRGPAVLATKAAAGTKKYDLSKWKYAELRDTINTSCDIELLAACREEFHRRLKVYHAWKSKNKKRNLEQSNVLQSLLLIMLSKTQQL

SEQ ID NO: 956 - protein, 121 aa, Homo sapiens
HFFGHLFRCHFGSCSIIFRSYRIGIQAPQRQVGLGLITDELGFTLGNPQGQLPVPALLLQNCLLLGFLLLLSGQLCLHFSLNAFFIIFPFLSLFFFLFSLCFHLKFHPPFLLFLSSTFFVF

SEQ ID NO: 957 - protein, 221 aa, Homo sapiens
  misc_feature (207)..(207): Xaa can be any naturally occurring amino acid
ERKRREEDEKRRRKEEEERRMKLEMEAKRKQEEEERKKREDDEKRIQAEVEAQLARQKEEESQQQAVLEQERRDRELALRIAQSEAELISDEAQADLALRRGPAVLATKAAAGTKKYDLSKWKYAELRDTINTSCDIELLAACREEFHRRLKVYHAWKSKNKKRNTETEQRAPKSVTDYAQQNPAAQIPARQREIEMNPTATLLSHXIHSALPDQYKRPSE

SEQ ID NO: 958 - protein, 93 aa, Homo sapiens
FSKCSASNIFLFKKFLVSFLAFEVLVIVDLFHKLCNSEILVFSKCLFYITDNFKMFSLCAVSIDSNVSSFKPNIYDFHIWNLKTKIHQGVMLT

SEQ ID NO: 959 - protein, 93 aa, Homo sapiens; identical to SEQ ID NO: 958

SEQ ID NO: 960 - protein, 193 aa, Homo sapiens
  misc_feature (165)..(165): Xaa can be any naturally occurring amino acid
  misc_feature (175)..(175): Xaa can be any naturally occurring amino acid
  misc_feature (177)..(177): Xaa can be any naturally occurring amino acid
  misc_feature (187)..(187): Xaa can be any naturally occurring amino acid
WWNHFRSKNVRRINLQKNIIGSSPVADFSAIKELDTLNNEIVDLQREKNNVEQDLKEKEDTIKQRTSEVQDLQDEVQRENTNLQKLQAQKQQVQELLDELDEQKAQLEEQLKEVRKKCAEEAQLISSLKAELTSQESQISTYEEELAKAREELSRLQQETQNWRXSVKSGKAQFXTXLAAPTRFTTXKLVQCQ

SEQ ID NO: 961 - protein, 82 aa, Homo sapiens
LTYRGKRIMWNRTLRRRKILLNRGQVRFRIFKMKFKGRILICKNYRPRNSRYRNSLMNWMSRKPSWRSNSRKSERNVLRRPN

SEQ ID NO: 962 - protein, 219 aa, Homo sapiens
  misc_feature (180)..(181): Xaa can be any naturally occurring amino acid
  misc_feature (191)..(191): Xaa can be any naturally occurring amino acid
  misc_feature (204)..(204): Xaa can be any naturally occurring amino acid
  misc_feature (217)..(217): Xaa can be any naturally occurring amino acid
AAQLSLTQLSSGNPVYEKYYRQVDTGNTGRVLASDAAAFLKKSGLPDLILGKIWDLADTDGKGILNKQEFFVALRLVACAQNGLEVSLSSLNLAVPPPRFHDTSSPLLISGTSAAELPWAVKPEDKAKYDAIFDSLSPVNGFLSGDKVKPVLLNSKLPVDILGRVWELSDIDHDGMLDRXXFAVAMFLVYXATGKKNLCQCPCXQPWVPPILRKKTXVG

SEQ ID NO: 963 - protein, 109 aa, Homo sapiens
LAKDYWYHEILVEEQPGSNYLVKLPIHSGHMPQDAKQQRILVCSGYLCHLCRLNPKSFQVSSLEALIFSGKQQHQKPTPFQYCLYQPVYSIFHIQDSHLITVSERAGPP

SEQ ID NO: 964 - protein, 118 aa, Homo sapiens
  misc_feature (3)..(3): Xaa can be any naturally occurring amino acid
  misc_feature (15)..(15): Xaa can be any naturally occurring amino acid
  misc_feature (28)..(28): Xaa can be any naturally occurring amino acid
  misc_feature (38)..(38): Xaa can be any naturally occurring amino acid
  misc_feature (40)..(40): Xaa can be any naturally occurring amino acid
PTXVFFLKMGGTQGXRQGHWHRFFFPVXQYTKNMATAXSXLSSIPSWSISLNSQTLPRISTGNLELSNTGFTLSPDRNPFTGLKLSNIASYLALSSGFTAHGSSAAEVPLISKGLLVS

SEQ ID NO: 965 - protein, 78 aa, Homo sapiens
  misc_feature (6)..(6): Xaa can be any naturally occurring amino acid
  misc_feature (8)..(8): Xaa can be any naturally occurring amino acid
  misc_feature (15)..(15): Xaa can be any naturally occurring amino acid
  misc_feature (24)..(24): Xaa can be any naturally occurring amino acid
  misc_feature (27)..(27): Xaa can be any naturally occurring amino acid
  misc_feature (29)..(29): Xaa can be any naturally occurring amino acid
  misc_feature (32)..(32): Xaa can be any naturally occurring amino acid
  misc_feature (34)..(34): Xaa can be any naturally occurring amino acid
  misc_feature (42)..(42): Xaa can be any naturally occurring amino acid
  misc_feature (44)..(44): Xaa can be any naturally occurring amino acid
  misc_feature (46)..(46): Xaa can be any naturally occurring amino acid
  misc_feature (52)..(53): Xaa can be any naturally occurring amino acid
  misc_feature (61)..(61): Xaa can be any naturally occurring amino acid
  misc_feature (69)..(70): Xaa can be any naturally occurring amino acid
  misc_feature (72)..(72): Xaa can be any naturally occurring amino acid
  misc_feature (74)..(75): Xaa can be any naturally occurring amino acid
TGQGPXKXRMAAMLXLLLALYLMXIFXGXKFXPXLSLKRNIXFXTXFVRNRXXFISQPPWXGFGGPKNXXKXKXXFFK

SEQ ID NO: 966 - protein, 181 aa, Homo sapiens
ELTVFQSKDVPEKTSSPEESIRMTKGITMATAKAVAAGNSCRQEDVIATANLSRKAVSDMLTACKQASFHPDVSDEVRTRALRFGTECTLGYLDLLEHVLVILQKPTPEFKQQLAAFSKRVAGAVTELIQAAEAMKGTEWVDPEDPTVIAETELLGAAASIEAAAKKLEQLKPRAKPKQAG

SEQ ID NO: 967 - protein, 90 aa, Homo sapiens
  misc_feature (43)..(43): Xaa can be any naturally occurring amino acid
  misc_feature (63)..(63): Xaa can be any naturally occurring amino acid
  misc_feature (77)..(77): Xaa can be any naturally occurring amino acid
LSTGSRGFVWMTLCELKQPLQGKEPTDCITAPAHQAPTAFRNXALWTTEEQNNRSVFWATKYXMGLGCTRSLHTEAXKRANRGGNFSPPG

SEQ ID NO: 968 - protein, 100 aa, Homo sapiens
  misc_feature (27)..(27): Xaa can be any naturally occurring amino acid
  misc_feature (47)..(47): Xaa can be any naturally occurring amino acid
  misc_feature (61)..(61): Xaa can be any naturally occurring amino acid
NSLCRVRSPQTVLQPLLTKPRRPSATXPFGLRRNKIIVQFSGPQNTXWVWVVQGAYTRRQXSVQTGAGIFHPLGEPVLKTWKEDLSHPPGVHTGLCFWLL

SEQ ID NO: 969 - protein, 125 aa, Homo sapiens
  misc_feature (4)..(5): Xaa can be any naturally occurring amino acid
  misc_feature (11)..(11): Xaa can be any naturally occurring amino acid
  misc_feature (15)..(15): Xaa can be any naturally occurring amino acid
  misc_feature (17)..(17): Xaa can be any naturally occurring amino acid
  misc_feature (24)..(24): Xaa can be any naturally occurring amino acid
  misc_feature (26)..(26): Xaa can be any naturally occurring amino acid
  misc_feature (29)..(29): Xaa can be any naturally occurring amino acid
  misc_feature (33)..(33): Xaa can be any naturally occurring amino acid
  misc_feature (35)..(36): Xaa can be any naturally occurring amino acid
  misc_feature (39)..(39): Xaa can be any naturally occurring amino acid
  misc_feature (41)..(41): Xaa can be any naturally occurring amino acid
  misc_feature (43)..(44): Xaa can be any naturally occurring amino acid
  misc_feature (56)..(56): Xaa can be any naturally occurring amino acid
  misc_feature (63)..(63): Xaa can be any naturally occurring amino acid
  misc_feature (67)..(67): Xaa can be any naturally occurring amino acid
  misc_feature (74)..(74): Xaa can be any naturally occurring amino acid
  misc_feature (76)..(76): Xaa can be any naturally occurring amino acid
  misc_feature (80)..(80): Xaa can be any naturally occurring amino acid
  misc_feature (82)..(82): Xaa can be any naturally occurring amino acid
  misc_feature (85)..(85): Xaa can be any naturally occurring amino acid
  misc_feature (104)..(104): Xaa can be any naturally occurring amino acid
GLKXXAKMRPXGNAXGXIGQTVFXKXWAXSETXPXXPGXSXKXXGVVFTFLSRGHXWNVRMSXVKCXTQNSFAXSXHASXCXRKXGCTFHGLVTNKEKSVLCCXQTLWLLLVLLLGLLLDLFMIL

SEQ ID NO: 970 - protein, 122 aa, Homo sapiens
  misc_feature (2)..(2): Xaa can be any naturally occurring amino acid
  misc_feature (4)..(5): Xaa can be any naturally occurring amino acid
  misc_feature (8)..(8): Xaa can be any naturally occurring amino acid
  misc_feature (10)..(10): Xaa can be any naturally occurring amino acid
  misc_feature (12)..(13): Xaa can be any naturally occurring amino acid
  misc_feature (25)..(25): Xaa can be any naturally occurring amino acid
  misc_feature (32)..(32): Xaa can be any naturally occurring amino acid
  misc_feature (36)..(36): Xaa can be any naturally occurring amino acid
  misc_feature (44)..(45): Xaa can be any naturally occurring amino acid
  misc_feature (49)..(49): Xaa can be any naturally occurring amino acid
  misc_feature (51)..(51): Xaa can be any naturally occurring amino acid
  misc_feature (54)..(54): Xaa can be any naturally occurring amino acid
  misc_feature (73)..(73): Xaa can be any naturally occurring amino acid
NXPXXSRXKXEXXGGCFHIFVPWAXVECSYVXGKMXYPKFFCRXXSCLXVXQKXGVHVSWTCYQQRKVSIMLXSDTLAFVGPSLRPAPGPLYDIVIGKKIIDVIEYSSSSQEKTEAGVGHGS

SEQ ID NO: 971 - protein, 169 aa, Homo sapiens
  misc_feature (26)..(26): Xaa can be any naturally occurring amino acid
  misc_feature (46)..(46): Xaa can be any naturally occurring amino acid
  misc_feature (84)..(84): Xaa can be any naturally occurring amino acid
CIKQELTVFQSKDVPEKTSSPEESIXMTKGITMATAKAVAAGNSCXQEDVIATANLSRKAVSDMLTACKQASFHPDVSDEVRTXALRFGTECTLGYLDLLEHVLVILQKPTPEFKQQLAAFSKRVAGAVTELIQAAEAMKGTEWVDPEDPTVIAETELLGAAASIEAAC

SEQ ID NO: 972 - protein, 112 aa, Homo sapiens
  misc_feature (5)..(5): Xaa can be any naturally occurring amino acid
RGENXSLAFRDGVHPWLLGPPGARLGDSSETNPRIQAAAGRFLQASRRRCDRAHPGGGSHERNRVGGSRRPNCHCRNRVTGGCSIHRSCLLKKLEQLKPRAKPKQADETLGL

SEQ ID NO: 973 - protein, 95 aa, Homo sapiens
  misc_feature (74)..(74): Xaa can be any naturally occurring amino acid
LCFCNDSWVFWIHPLCSFHGFRRLDELCHSAGDSLGESGQLLLEFWGWFLKNHQDVLQEVQVAKGALRPETQGXGSHLVTDIGVEGCLLASRQHI

SEQ ID NO: 974 - protein, 95 aa, Homo sapiens
  misc_feature (12)..(12): Xaa can be any naturally occurring amino acid
  misc_feature (50)..(50): Xaa can be any naturally occurring amino acid
  misc_feature (70)..(70): Xaa can be any naturally occurring amino acid
PRVHSVPKRKAXVLTSSLTSGWKDACLQAVNISDTAFRLRLAVAITSSCXHEFPAATALAVAMVMPFVIXMDSSGDDVFSGTSFDWNTVSSCFMH

SEQ ID NO: 975 - protein, 159 aa, Homo sapiens
  misc_feature (2)..(3): Xaa can be any naturally occurring amino acid
  misc_feature (10)..(10): Xaa can be any naturally occurring amino acid
  misc_feature (13)..(13): Xaa can be any naturally occurring amino acid
  misc_feature (17)..(18): Xaa can be any naturally occurring amino acid
  misc_feature (26)..(26): Xaa can be any naturally occurring amino acid
  misc_feature (35)..(35): Xaa can be any naturally occurring amino acid
  misc_feature (38)..(39): Xaa can be any naturally occurring amino acid
  misc_feature (42)..(42): Xaa can be any naturally occurring amino acid
  misc_feature (46)..(46): Xaa can be any naturally occurring amino acid
  misc_feature (48)..(49): Xaa can be any naturally occurring amino acid
  misc_feature (60)..(60): Xaa can be any naturally occurring amino acid
  misc_feature (65)..(65): Xaa can be any naturally occurring amino acid
  misc_feature (81)..(81): Xaa can be any naturally occurring amino acid
  misc_feature (85)..(86): Xaa can be any naturally occurring amino acid
  misc_feature (88)..(88): Xaa can be any naturally occurring amino acid
  misc_feature (90)..(91): Xaa can be any naturally occurring amino acid
RXXGGTQKGXPQXMAPXXNWTNKFSXKVGPLSWKXAPXXPGXSLEXLXXLFSHFLSPWAXGGMFXMSHGYNCLTHKFFCRXPSCXXVXQXXGVHVSWTCYQQRKVSIMLFSDTLAFVGPSLRPAPGPLYDIVIGKKIIDVIEYSSSSQEKTEAGVGHGS

SEQ ID NO: 976 - protein, 118 aa, Homo sapiens
  misc_feature (1)..(1): Xaa can be any naturally occurring amino acid
  misc_feature (8)..(8): Xaa can be any naturally occurring amino acid
  misc_feature (11)..(11): Xaa can be any naturally occurring amino acid
  misc_feature (15)..(16): Xaa can be any naturally occurring amino acid
  misc_feature (23)..(23): Xaa can be any naturally occurring amino acid
  misc_feature (33)..(33): Xaa can be any naturally occurring amino acid
  misc_feature (35)..(36): Xaa can be any naturally occurring amino acid
  misc_feature (40)..(40): Xaa can be any naturally occurring amino acid
  misc_feature (43)..(43): Xaa can be any naturally occurring amino acid
  misc_feature (45)..(46): Xaa can be any naturally occurring amino acid
  misc_feature (58)..(58): Xaa can be any naturally occurring amino acid
  misc_feature (63)..(63): Xaa can be any naturally occurring amino acid
  misc_feature (78)..(78): Xaa can be any naturally occurring amino acid
  misc_feature (82)..(82): Xaa can be any naturally occurring amino acid
  misc_feature (84)..(85): Xaa can be any naturally occurring amino acid
  misc_feature (88)..(88): Xaa can be any naturally occurring amino acid
XWNPKGEXPGXGPWXXLDKQVFXKGWAIKLETXPXXSRVXPGXPXXFVFTFFVPVGHXWNVRXVTRVQLSYPQILLPXPFMXHXXSEXRGARFMDLLPTKKSQYYVVLRHFGFCWSFS

SEQ ID NO: 977 - protein, 141 aa, Homo sapiens
  misc_feature (3)..(3): Xaa can be any naturally occurring amino acid
  misc_feature (6)..(6): Xaa can be any naturally occurring amino acid
  misc_feature (17)..(17): Xaa can be any naturally occurring amino acid
  misc_feature (33)..(33): Xaa can be any naturally occurring amino acid
  misc_feature (39)..(39): Xaa can be any naturally occurring amino acid
  misc_feature (43)..(43): Xaa can be any naturally occurring amino acid
  misc_feature (46)..(46): Xaa can be any naturally occurring amino acid
WLXASXCSVLMCVSWKXARLAAQRGQSVRLWLXRGCRRXLWGXRLXLRGRLRGRRGLWGLLRGWRRRLLLGHPHVARARRGGRGAADAVAARVGDLAVRGRHPRVAVGRQVLVKLVDIEGLDVGDDVAAQLADVHVAEVDR

SEQ ID NO: 978 - protein, 72 aa, Homo sapiens
  misc_feature (3)..(3): Xaa can be any naturally occurring amino acid
  misc_feature (20)..(20): Xaa can be any naturally occurring amino acid
  misc_feature (25)..(25): Xaa can be any naturally occurring amino acid
  misc_feature (29)..(29): Xaa can be any naturally occurring amino acid
  misc_feature (33)..(33): Xaa can be any naturally occurring amino acid
LEXGPASCSAWSECAPVAAXGVPPXAVGXPPTXAGAPAGPAGPVGAAAGVAAAPAAWTSTRGPRSPGWPRCC

SEQ ID NO: 979 - protein, 96 aa, Homo sapiens
  misc_feature (96)..(96): Xaa can be any naturally occurring amino acid
PIDFRDVDIGELSSDVISNIETFDVNEFDQYLPPNGHPGVPATHGQVTYTGSYGISSTAATPASAGHVWMSKQQAPPPPPQQPPQAPPAPQAPPQX

SEQ ID NO: 980 - protein, 103 aa, Homo sapiens
  misc_feature (83)..(83): Xaa can be any naturally occurring amino acid
  misc_feature (87)..(87): Xaa can be any naturally occurring amino acid
  misc_feature (91)..(91): Xaa can be any naturally occurring amino acid
  misc_feature (96)..(96): Xaa can be any naturally occurring amino acid
AATSSPTSRPSMSTSLTSTCRPTATRGCRPRTARSPTRAATASAAPRPPRRARATCGCPSSRRRRHPRSSPHRPRRPRRRPRXRRRXPHSXRRHPXSSHRRTL

SEQ ID NO: 981 - protein, 164 aa, Homo sapiens
  misc_feature (130)..(130): Xaa can be any naturally occurring amino acid
DAGAHAGARQRLQQEQAARQAAHERLHGVGAGGAQEARGPVPALAQRRAQQDAGQALETSEREREAALRGGGGAAARAAQEGPPGLQVPAAAEEVGEERAGGGRGGHGADAHLPQRHLQGAAGRLATLLXRHERGALPRRALGAIPGPTDPTHHPQNRRAAGQG

SEQ ID NO: 982 - protein, 192 aa, Homo sapiens
  misc_feature (130)..(130): Xaa can be any naturally occurring amino acid
  misc_feature (190)..(190): Xaa can be any naturally occurring amino acid
TLVPMPVRVNGSSKNKPHVKRPMNAFMVWAQAARRKLADQYPHLHNAELSKTLGKLWRLLNESEKRPFVEEAERLRVQHKKDHPDYKYQPRRRKSVKNGQAEAEEATEQTHISPNAIFKALQADSPHSSXGMSEVHSPGEHSGQSQGPPTPPTTPKTDVQPGKADLKREGRPLPEGGRQAPYRLSRRGHXAS

SEQ ID NO: 983 - protein, 196 aa, Homo sapiens
  misc_feature (7)..(7): Xaa can be any naturally occurring amino acid
  misc_feature (67)..(67): Xaa can be any naturally occurring amino acid
RRCSARXMSTSRKSIGGLSAPLWQGAPLSLQVSLARLHVGFGGGGWGRWALGLPRVLAGGVHLAHAXGGVWRVGLQRLEDGVGGDVRLLRGLLCLRLPVLHRLPPPRLVLVIRVVLLVLHAQPLRLLHEGPLLALVQKSPELAQRLAELGVVQVRVLVRELPARRLRPHHEGVHGPLDVRLVLAGAVDAHRHGHQR

SEQ ID NO: 984 - protein, 99 aa, Homo sapiens
  misc_feature (13)..(13): Xaa can be any naturally occurring amino acid
  misc_feature (18)..(18): Xaa can be any naturally occurring amino acid
  misc_feature (31)..(31): Xaa can be any naturally occurring amino acid
  misc_feature (45)..(45): Xaa can be any naturally occurring amino acid
  misc_feature (47)..(47): Xaa can be any naturally occurring amino acid
  misc_feature (57)..(57): Xaa can be any naturally occurring amino acid
  misc_feature (59)..(59): Xaa can be any naturally occurring amino acid
  misc_feature (64)..(65): Xaa can be any naturally occurring amino acid
  misc_feature (70)..(70): Xaa can be any naturally occurring amino acid
  misc_feature (72)..(72): Xaa can be any naturally occurring amino acid
  misc_feature (79)..(80): Xaa can be any naturally occurring amino acid
  misc_feature (84)..(84): Xaa can be any naturally occurring amino acid
  misc_feature (90)..(90): Xaa can be any naturally occurring amino acid
  misc_feature (95)..(96): Xaa can be any naturally occurring amino acid
MSLRKKKKKKKQXQNKKXKKTPMSKGEFWVXSFSFFGLFFRDHLXHXRPLWGGPPQXSXWKLGXXTGFVXKXLGGLGGXXPGMXKGDPHXGVRAXXGGW

SEQ ID NO: 985 - protein, 96 aa, Homo sapiens
  misc_feature (10)..(10): Xaa can be any naturally occurring amino acid
  misc_feature (15)..(15): Xaa can be any naturally occurring amino acid
  misc_feature (27)..(27): Xaa can be any naturally occurring amino acid
  misc_feature (41)..(41): Xaa can be any naturally occurring amino acid
  misc_feature (43)..(44): Xaa can be any naturally occurring amino acid
  misc_feature (53)..(53): Xaa can be any naturally occurring amino acid
  misc_feature (56)..(56): Xaa can be any naturally occurring amino acid
  misc_feature (61)..(62): Xaa can be any naturally occurring amino acid
  misc_feature (66)..(66): Xaa can be any naturally occurring amino acid
  misc_feature (69)..(69): Xaa can be any naturally occurring amino acid
  misc_feature (76)..(77): Xaa can be any naturally occurring amino acid
  misc_feature (80)..(80): Xaa can be any naturally occurring amino acid
  misc_feature (87)..(87): Xaa can be any naturally occurring amino acid
  misc_feature (92)..(93): Xaa can be any naturally occurring amino acid
GRRRRRKNKXKIKKXKKHQCPKGNSGXGPSLSSGYFLGIIXAXXALCGEALLXGPXGNLGXXPGLXPNXWGGLVGXXRGXGKGTPIXVFGPXXGGG

SEQ ID NO: 986 - protein, 133 aa, Homo sapiens
GHPEGPGAHLDMNSLDRAQAAKNKGNKYFKAGKYEQAIQCYTEAISLCPTEKNVDLSTFYQNRAAAFEQLQKWKEVAQDCTKAVELNPKYVKALFRRAKAHEKLDNKKECLEDVTAVCILEGFQNQQSMLLAR

SEQ ID NO: 987 - protein, 103 aa, Homo sapiens
LLMGFCTSKESFHIFGIKFNSFCTVLCHFFPFLQLFKGSSSVLIKCRKVNILLCRAQANSLSIALNSLFIFSCFKIFIAFILGCLGSIKRVHVQVSTGTFRVS

SEQ ID NO: 988 - protein, 64 aa, Homo sapiens [sequence omitted]

SEQ ID NO: 989 - protein, 77 aa, Homo sapiens [sequence omitted]

SEQ ID NO: 990 - protein, 218 aa, Homo sapiens
  misc_feature (195)..(195): Xaa can be any naturally occurring amino acid
  misc_feature (208)..(208): Xaa can be any naturally occurring amino acid
  misc_feature (213)..(213): Xaa can be any naturally occurring amino acid
PGSGHPEGPGAHLDMNSLDRAQAAKNKGNKYFKAGKYEQAIQCYTEAISLCPTEKNVDLSTFYQNRAAAFEQLQKWKEVAQDCTKAVELNPKYVKALFRRAKAHEKLDNKKECLEDVTAVCILEGFQNQQSMLLADKVLKLLGKEKAKEKYKNREPLMPSPQFIKSYFSSFTDDIISQPMLKGEKSDEDKDKEGXALEVKRKFWILKXPTVYXRRKLR

SEQ ID NO: 991 - protein, 268 aa, Homo sapiens
ENIMVFNWWALFSEKAVHLQEELIAINSKKEELNQSVNRVKELELELESVKAQSLAITKQNHMLNEKVKEMSDYSLLKEEKLELLAQNKLLKQQLEESRNENLRLLNRLAQPAPELAVFQKELRKAEKAIVVEHEEFESCRQALHKQLQDEIEHSAQLKAQILGYKASVKSLTTQVADLKLQLKQTQTALENEVYCNPKQSVIDRSVNGLINGNVVPCNGEISGDFLNNPFKQENVLARMGASRITNYPTAWVEGSSPDSDLEFVAQY

SEQ ID NO: 992 - protein, 219 aa, Homo sapiens
  misc_feature (200)..(200): Xaa can be any naturally occurring amino acid
  misc_feature (205)..(205): Xaa can be any naturally occurring amino acid
VKAQSLAITKQNHMLNEKVKEMSDYSLLKEEKLELLAQNKLLKQQLEESRNENLRLLNRLAQPAPELAVFQKELRKAEKAIVVEHEEFESCRQALHKQLQDEIEHSAQLKAQILGYKASVKSLTTQVADLKLQLKQTQTALENEVYCNPKQSVIDRSVNGLINGNVVPCNGEISGDFLNNPFKQENVLARMGASRITNYXTAWVXGSSPDSDLEFVAQY

SEQ ID NO: 993 - protein, 194 aa, Homo sapiens
  misc_feature (20)..(20): Xaa can be any naturally occurring amino acid
  misc_feature (29)..(29): Xaa can be any naturally occurring amino acid
  misc_feature (57)..(57): Xaa can be any naturally occurring amino acid
MRSLNHLFGFCREHAKASWXMGGLSPAGXYVSCGRCCSCLCPSHISTQGVDQKQIEXQKEEEKIREQQVKERRQREERRQSNLQEVLERERRELEKLYQERKMIEESLKIKIKKELEMENELEMSNQEIKDKSAHSENPLEKYMKIIQQEQDQESADKSSKKMVQEGSLVDTLQSSDKVESLTGFSHEELDDSW

SEQ ID NO: 994 - protein, 189 aa, Homo sapiens
  misc_feature (175)..(175): Xaa can be any naturally occurring amino acid
ENIMVFNWWALFSEKAVHLQEELIAINSKKEELNQSVNRVKELELELESVKAQSLAITKQNHMLNEKVKEMSDYSLLKEEKLELLAQNKLLKQQLEESRNENLRLLNRLAQPAPELAVFQKELRKAEKAIVVEHEEFESCRQALHKQLQDEIEHSAQLKAQILGYKASVKSLTTXVADLKLQLKQTQTP

SEQ ID NO: 995 - protein, 125 aa, Homo sapiens
  misc_feature (14)..(14): Xaa can be any naturally occurring amino acid
  misc_feature (117)..(117): Xaa can be any naturally occurring amino acid
KTEGREKERRQSNXQEVLERERRELEKLYQERKMIEESLKIKIKKELEMENELEMSNQEIKDKSAHSENPLEKYMKIIQQEQDQESADKSSKKMVQEGSLVDTLQSSDKVESLTGFXHEELDDSW

SEQ ID NO: 996 - protein, 466 aa, Homo sapiens
  misc_feature (223)..(223): Xaa can be any naturally occurring amino acid
  misc_feature (456)..(456): Xaa can be any naturally occurring amino acid
  misc_feature (466)..(466): Xaa can be any naturally occurring amino acid
TIHQVSLDLDSLAESPESDFMSAVNEFVIEENLSSPNPISDPQSPEMMVESLYSSVINAIDSRRMQDTNVCGKEDFGDHTSLNVQLERCRVVAQDSHFSIQTIKEDLCHFRTFVQKEQCDFSNSLKCTAVEIRNIIEKVKCSLEITLKEKHQKELLSLKNEYEGKLDGLIKETEENENKIKKLKGELVCLEEVLQNKDNEFALVKHEKEAVICLQNEKDQKLXEMENIMHSQNCEIKELKQSREIVLEDLKKLHVENDEKLQLLRAELQSLEQSHLKELEDTLQVRHIQEFEKVMTDHRVSLEELKKENQQIINQIQESHAEIIQEKEKQLQELKLKVSDLSDTRCKLEVELALKEAETDEIKILLEESRAQQKETLKSLLEQETENLRTEISKLNQKIQDNNENYQVGLAELRTLMTIEKDQCISELISRHEEESNILKAELNKSYIFCITQPFXIEKNLKEPIX

SEQ ID NO: 997 - protein, 237 aa, Homo sapiens
  misc_feature (202)..(202): Xaa can be any naturally occurring amino acid
  misc_feature (214)..(214): Xaa can be any naturally occurring amino acid
  misc_feature (227)..(227): Xaa can be any naturally occurring amino acid
  misc_feature (237)..(237): Xaa can be any naturally occurring amino acid
HSQNCEIKELKQSREIVLEDLKKLHVENDEKLQLLRAELQSLEQSHLKELEDTLQVRHIQEFEKVMTDHRVSLEELKKENQQIINQIQESHAEIIQEKEKQLQELKLKVSDLSDTRCKLEVELALKEAETDEIKILLEESRAQQKETLKSLLEQETENLRTEISKLNQKIQDNNENYQVGLAELRTLMTIEKDQCISELISXHEEESNILKAEXNKSYIFCITQPFXIEKNLKEPIX

SEQ ID NO: 998 - protein, 278 aa, Homo sapiens
  misc_feature (223)..(223): Xaa can be any naturally occurring amino acid
  misc_feature (237)..(237): Xaa can be any naturally occurring amino acid
  misc_feature (261)..(261): Xaa can be any naturally occurring amino acid
  misc_feature (266)..(266): Xaa can be any naturally occurring amino acid
  misc_feature (268)..(268): Xaa can be any naturally occurring amino acid
  misc_feature (275)..(276): Xaa can be any naturally occurring amino acid
TIHQVSLDLDSLAESPESDFMSAVNEFVIEENLSSPNPISDPQSPEMMVESLYSSVINAIDSRRMQDTNVCGKEDFGDHTSLNVQLERCRVVAQDSHFSIQTIKEDLCHFRTFVQKEQCDFSNSLKCTAVEIRNIIEKVKCSLEITLKEKHQKELLSLKNEYEGKLDGLIKETEENENKIKKLKGELVCLEEVLQNKDNEFALVKHEKEAVICLQNEKDQKLXEMENIMPSQNWEIXELKQSREIGLEDLKKLMWKMMRSXGFGGXTXVLGPKSXXGI

SEQ ID NO: 999 - protein, 168 aa, Homo sapiens
  misc_feature (1)..(3): Xaa can be any naturally occurring amino acid
  misc_feature (8)..(8): Xaa can be any naturally occurring amino acid
  misc_feature (10)..(10): Xaa can be any naturally occurring amino acid
  misc_feature (18)..(18): Xaa can be any naturally occurring amino acid
  misc_feature (31)..(31): Xaa can be any naturally occurring amino acid
  misc_feature (34)..(34): Xaa can be any naturally occurring amino acid
  misc_feature (38)..(38): Xaa can be any naturally occurring amino acid
  misc_feature (40)..(40): Xaa can be any naturally occurring amino acid
  misc_feature (43)..(43): Xaa can be any naturally occurring amino acid
  misc_feature (46)..(46): Xaa can be any naturally occurring amino acid
  misc_feature (48)..(48): Xaa can be any naturally occurring amino acid
  misc_feature (50)..(50): Xaa can be any naturally occurring amino acid
  misc_feature (59)..(59): Xaa can be any naturally occurring amino acid
  misc_feature (65)..(65): Xaa can be any naturally occurring amino acid
  misc_feature (67)..(69): Xaa can be any naturally occurring amino acid
  misc_feature (75)..(75): Xaa can be any naturally occurring amino acid
  misc_feature (81)..(81): Xaa can be any naturally occurring amino acid
  misc_feature (86)..(88): Xaa can be any naturally occurring amino acid
  misc_feature (94)..(94): Xaa can be any naturally occurring amino acid
  misc_feature (99)..(99): Xaa can be any naturally occurring amino acid
  misc_feature (104)..(104): Xaa can be any naturally occurring amino acid
  misc_feature (108)..(108): Xaa can be any naturally occurring amino acid
  misc_feature (112)..(114): Xaa can be any naturally occurring amino acid
  misc_feature (117)..(117): Xaa can be any naturally occurring amino acid
  misc_feature (119)..(120): Xaa can be any naturally occurring amino acid
  misc_feature (125)..(127): Xaa can be any naturally occurring amino acid
  misc_feature (131)..(131): Xaa can be any naturally occurring amino acid
  misc_feature (137)..(137): Xaa can be any naturally occurring amino acid
  misc_feature (139)..(141): Xaa can be any naturally occurring amino acid
  misc_feature (148)..(149): Xaa can be any naturally occurring amino acid
  misc_feature (153)..(153): Xaa can be any naturally occurring amino acid
  misc_feature (158)..(158): Xaa can be any naturally occurring amino acid
  misc_feature (160)..(160): Xaa can be any naturally occurring amino acid
  misc_feature (164)..(165): Xaa can be any naturally occurring amino acid
XXXHEEEXNXLKGELNKXTSLHNQAFEIEKXLKXQIIXLXSKXDSXLXAXESQKDEKIXPQEEKXEXXXQTLEKXSQKLVXSQEQXXXQLIQKXNCEKXEAIQXALKXFKLXXXVVXKXXLEKVXXXENQXAKSPAXDXXXGDFSSLXXELQXKLQEXKXKFLXXLEE

SEQ ID NO: 1000 - protein, 194 aa, Homo sapiens
EGKLQKALEDAFLAIDAKLTTEEVIKELAQIAGRPTEDEDEKEKVADEDDVDNEEAALLHEEATMTIEELLTRYGQNCHKGPPHSKSGGGTGEEPGSQGLNGEAGPEDSTRETPSQENGPTAKAYTGFSSNSERGTEAGQVGEPGIPTGEAGPSCSSASDKLLELLSPSSLRTVRMSQMKRRKKKKTVRNAARK

SEQ ID NO: 1001 - protein, 73 aa, Homo sapiens
RVSSSSIVMVASSCSSAASSLSTSSSSATFSFSSSSSVGRPAICASSLMTSSVVNLASIAKKASSKAFCSLPS

SEQ ID NO: 1002 - protein, 121 aa, Homo sapiens
  misc_feature (3)..(3): Xaa can be any naturally occurring amino acid
  misc_feature (5)..(5): Xaa can be any naturally occurring amino acid
  misc_feature (10)..(10): Xaa can be any naturally occurring amino acid
  misc_feature (19)..(19): Xaa can be any naturally occurring amino acid
  misc_feature (40)..(40): Xaa can be any naturally occurring amino acid
  misc_feature (53)..(53): Xaa can be any naturally occurring amino acid
  misc_feature (59)..(59): Xaa can be any naturally occurring amino acid
  misc_feature (79)..(79): Xaa can be any naturally occurring amino acid
HKXVXFTEAXNSWSLPGGXWNVMTTQKVVDFIQSKISQAXENGKFGIVIHCEXLLDQCXAPDTFGDGTGCDNMTCIIIXFKPRNTAELQPESGKRKLEEVLSTEGAEENGNSDKKKKAKRD

SEQ ID NO: 1003 - protein, 122 aa, Homo sapiens
  misc_feature (37)..(37): Xaa can be any naturally occurring amino acid
  misc_feature (57)..(57): Xaa can be any naturally occurring amino acid
  misc_feature (84)..(84): Xaa can be any naturally occurring amino acid
  misc_feature (91)..(91): Xaa can be any naturally occurring amino acid
RRCSLLRGLKKMATATRRRRPSETSSHPDPCPPRLFXEPSGPETEFCLFPLALAVGXRCAGGAGWLHSAHSKEGSPSTLQPGAXAVLPSRXCSSGSSPVLCLCSVVLEGRTGGSGFYSVNFI

SEQ ID NO: 1004 - protein, 176 aa, Homo sapiens
  misc_feature (69)..(69): Xaa can be any naturally occurring amino acid
AAQLRMVDDGSGKVEVWCIQDLHRQPVDPKRHGQLCAGNCYLVLYTYQRLGRVQYILYLWQGHQATADXIEALNSNAEELDVMYGGVLVQEHVTMGSEPPHFLAIFQGQLVIFQERAGHHGKGQSASTTRLFQVQGTDSHNTRTMEVPARASSLNSSDIFLLVTSQRLLPLVWEGL

SEQ ID NO: 1005 - protein, 143 aa, Homo sapiens
  misc_feature (119)..(119): Xaa can be any naturally occurring amino acid
PPPVPSHVDHHYSPSQTRGSRRWLVTSKKMSLELRDEARAGTSMVLVLWLSVPCTWKSLVVDADCPFPWCPALSWKITSWPWKMARKWGGSLPMVTCSCTRTPPYMTSSSSALLFRASXSSAVAWWPCHRYRMYWTRPSLWYV

SEQ ID NO: 1006 - protein, 145 aa, Homo sapiens
  misc_feature (2)..(2): Xaa can be any naturally occurring amino acid
  misc_feature (19)..(19): Xaa can be any naturally occurring amino acid
  misc_feature (33)..(33): Xaa can be any naturally occurring amino acid
  misc_feature (56)..(56): Xaa can be any naturally occurring amino acid
  misc_feature (72)..(72): Xaa can be any naturally occurring amino acid
  misc_feature (78)..(78): Xaa can be any naturally occurring amino acid
  misc_feature (90)..(90): Xaa can be any naturally occurring amino acid
  misc_feature (100)..(101): Xaa can be any naturally occurring amino acid
  misc_feature (111)..(111): Xaa can be any naturally occurring amino acid
  misc_feature (114)..(114): Xaa can be any naturally occurring amino acid
  misc_feature (119)..(119): Xaa can be any naturally occurring amino acid
PXVPQESGEWQPGKQHQPXFEITAEVNNLGLSXWPGNGRAGAVALQALKGSQDSSXNDLVRSPKSAGSRTSXSVSSTXATINGGLRREQXMHQAVEDLPXXVDPARREFYXSDXDFQDXFGKSKEEFYSMATWRQRQEKKQLGFF

SEQ ID NO: 1007 - protein, 98 aa, Homo sapiens
  misc_feature (9)..(9): Xaa can be any naturally occurring amino acid
  misc_feature (11)..(11): Xaa can be any naturally occurring amino acid
  misc_feature (20)..(21): Xaa can be any naturally occurring amino acid
  misc_feature (24)..(24): Xaa can be any naturally occurring amino acid
  misc_feature (29)..(29): Xaa can be any naturally occurring amino acid
  misc_feature (60)..(60): Xaa can be any naturally occurring amino acid
  misc_feature (84)..(84): Xaa can be any naturally occurring amino acid
  misc_feature (91)..(91): Xaa can be any naturally occurring amino acid
CTRLLRTCXRXWTLPAGSSXXQTXTSKIXLGNPRRNFTAWPRGGSGRRKSSWAFFEPKPXRLPLSPGPQHTYNAGEALLPLPSXAFGHPLXVSKSRQP

SEQ ID NO: 1008 - protein, 65 aa, Homo sapiens
  misc_feature (9)..(9): Xaa can be any naturally occurring amino acid
  misc_feature (24)..(25): Xaa can be any naturally occurring amino acid
  misc_feature (28)..(28): Xaa can be any naturally occurring amino acid
  misc_feature (30)..(30): Xaa can be any naturally occurring amino acid
  misc_feature (37)..(37): Xaa can be any naturally occurring amino acid
  misc_feature (39)..(39): Xaa can be any naturally occurring amino acid
  misc_feature (44)..(44): Xaa can be any naturally occurring amino acid
  misc_feature (48)..(48): Xaa can be any naturally occurring amino acid
  misc_feature (55)..(55): Xaa can be any naturally occurring amino acid
  misc_feature (58)..(59): Xaa can be any naturally occurring amino acid
  misc_feature (62)..(62): Xaa can be any naturally occurring amino acid
STCRGPKVXNHPMKGGEALWPCLXXTNXCXPGFLPLXGXKSFKXTSLXPKANPPXFPXXFCXFSP

SEQ ID NO: 1009 - protein, 193 aa, Homo sapiens
YLVALDKLNPYTLYTFRIRCSTETFWKWSKWSNKKQHLTTEASPSKGPDTWREWSSDGKNLIIYWKPLPINEANGKILSYNVSCSSDEETQSLSEIPDPQHKAEIRLDKNDYIISVVAKNSVGSSPPSKIASMEIPNDDLKIEQVVGMGKGILLTWHYDPNMTCDYVIKWCNSSRSEPCLMDWRKVPQTALKL

SEQ ID NO: 1010 - protein, 135 aa, Homo sapiens
  misc_feature (1)..(1): Xaa can be any naturally occurring amino acid
  misc_feature (10)..(10): Xaa can be any naturally occurring amino acid
  misc_feature (12)..(12): Xaa can be any naturally occurring amino acid
  misc_feature (17)..(17): Xaa can be any naturally occurring amino acid
  misc_feature (32)..(32): Xaa can be any naturally occurring amino acid
XFPRNVFPFXLXIESAXVSFTSKFGHQWEPIXLYIQSWSVIIDILDFCIHTGKNYILYLVETHQILLQFQCCLRNFSPVHKAWFRPRRVTPLNDVVASHVGVVMPGEENPLSHPNNLFYFEIIIWNFHTRYFGRW

SEQ ID NO: 1011 - protein, 80 aa, Homo sapiens
  misc_feature (1)..(1): Xaa can be any naturally occurring amino acid
  misc_feature (4)..(4): Xaa can be any naturally occurring amino acid
  misc_feature (13)..(13): Xaa can be any naturally occurring amino acid
  misc_feature (21)..(23): Xaa can be any naturally occurring amino acid
  misc_feature (27)..(27): Xaa can be any naturally occurring amino acid
  misc_feature (37)..(37): Xaa can be any naturally occurring amino acid
  misc_feature (40)..(40): Xaa can be any naturally occurring amino acid
  misc_feature (50)..(50): Xaa can be any naturally occurring amino acid
  misc_feature (63)..(63): Xaa can be any naturally occurring amino acid
XNHXTRGKRPKVXWIWSPRGXXXVGCXPSQGILPLWXMSXHSESFPQPPXLVPSSHFKYKTKXRMLLTGPVPKGCFLELS

SEQ ID NO: 1012 - protein, 77 aa, Homo sapiens
  misc_feature (1)..(1): Xaa can be any naturally occurring amino acid
  misc_feature (5)..(5): Xaa can be any naturally occurring amino acid
  misc_feature (13)..(13): Xaa can be any naturally occurring amino acid
  misc_feature (22)..(23): Xaa can be any naturally occurring amino acid
  misc_feature (27)..(27): Xaa can be any naturally occurring amino acid
  misc_feature (37)..(38): Xaa can be any naturally occurring amino acid
  misc_feature (40)..(40): Xaa can be any naturally occurring amino acid
  misc_feature (51)..(51): Xaa can be any naturally occurring amino acid
  misc_feature (63)..(63): Xaa can be any naturally occurring amino acid
XLTIXPGVSGQKXDGFGPPEEXXPWVXPQARVFCPFXXCXPTQSLFLSPHXLSRPHILNIKLXRECFLQDQYPRAVS

SEQ ID NO: 1013 - protein, 117 aa, Homo sapiens [sequence omitted]

SEQ ID NO: 1014 - protein, 212 aa, Homo sapiens
  misc_feature (185)..(185): Xaa can be any naturally occurring amino acid
  misc_feature (198)..(198): Xaa can be any naturally occurring amino acid
  misc_feature (200)..(200): Xaa can be any naturally occurring amino acid
  misc_feature (205)..(205): Xaa can be any naturally occurring amino acid
ISDNSKINFRLKPLDVAFMKAIHNKVNIVPVIAKADTLTLKERERLKKRILDEIEEHNIKIYHLPDAESDEDEDFKEQTRLLKASIPFSVVGSNQLIEAKGKKVRGRLYPWGVVEVENPEHNDFLKLRTMLITHMQDLQEVTQDLHYENFRSERLKRGGRKVENEDMNKDQILLEKEAELRRMQXMIARMQAPNADAXCXAGDGXGGAFRAT

SEQ ID NO: 1015 - protein, 143 aa, Homo sapiens
  misc_feature (8)..(8): Xaa can be any naturally occurring amino acid
  misc_feature (13)..(13): Xaa can be any naturally occurring amino acid
  misc_feature (15)..(15): Xaa can be any naturally occurring amino acid
  misc_feature (28)..(28): Xaa can be any naturally occurring amino acid
GGPKSPAXAIPGXAXGICIWGLHPCNHXLHAAELSFFFQQDLVFIHVLILHFPAASLESLRTEVFIMKVLGHLLEILHVGDEHGSQLQKVIVLWVLHFHNTPGVEAASDLLSFGFNQLIGSNHREWDASLEKSSLLFKIFIFI

SEQ ID NO: 1016 - protein, 120 aa, Homo sapiens
  misc_feature (59)..(59): Xaa can be any naturally occurring amino acid
  misc_feature (62)..(62): Xaa can be any naturally occurring amino acid
  misc_feature (69)..(69): Xaa can be any naturally occurring amino acid
  misc_feature (76)..(76): Xaa can be any naturally occurring amino acid
  misc_feature (78)..(78): Xaa can be any naturally occurring amino acid
  misc_feature (83)..(83): Xaa can be any naturally occurring amino acid
  misc_feature (86)..(87): Xaa can be any naturally occurring amino acid
  misc_feature (93)..(93): Xaa can be any naturally occurring amino acid
  misc_feature (95)..(95): Xaa can be any naturally occurring amino acid
  misc_feature (111)..(111): Xaa can be any naturally occurring amino acid
  misc_feature (119)..(119): Xaa can be any naturally occurring amino acid
HTFINYYYLTASFYGFSSPHKNEKTLSHPQIKHFLHLPTQPLAPFIWQFLGGEFPTSVXMDXKRHPLEXSLRGPQXKXGTLRXPGXXKTKPGXGXNGADLAPYPLLQNLKXVFPFDLAXR

SEQ ID NO: 1017 - protein, 111 aa, Homo sapiens
VFSKYISIGRDYVLVKEQLSIIKSIYLDLGSKTKGDQKCSSVGPPSLHSCYQEAACLKYFHSHMRGLVTSKLVFLFYRFSSKVIKCQTQIMDSAWMYSEVMEHHFLVTFTQ

SEQ ID NO: 1018 - protein, 219 aa, Homo sapiens
RERVTQSALVPVLAMASFVTEVLAHSGRLEKEDLGTRISRLTRRVEEIKGEVCNMISKKYSEFLPSMQSAQGLITQVDKLSEDIDLLKSRIESEVRRDLHVSTGEFTDLKQQLERDSVVLSLLKQLQEFSTAIEEYNCALTEKKYVTGAQRLEEAQKCLKLLKSRKCFDLKILKSLSMELTIQETEHTLSPWRRVAEADCMEVPTIKRYQPVWESLPYK

SEQ ID NO: 1019 - protein, 99 aa, Homo sapiens
RSRRTSLSILDFSRSMSSDSLSTWVIRPCALCMLGRNSLYFLLIILHTSPLISSTRRVRRLIRVPRSSFSSLPECAKTSVTNEAMAKTGTNADWVTLSL

SEQ ID NO: 1020 - protein, 131 aa, Homo sapiens
  misc_feature (23)..(23): Xaa can be any naturally occurring amino acid
  misc_feature (70)..(70): Xaa can be any naturally occurring amino acid
  misc_feature (76)..(76): Xaa can be any naturally occurring amino acid
  misc_feature (78)..(78): Xaa can be any naturally occurring amino acid
  misc_feature (86)..(86): Xaa can be any naturally occurring amino acid
  misc_feature (109)..(109): Xaa can be any naturally occurring amino acid
  misc_feature (118)..(118): Xaa can be any naturally occurring amino acid
  misc_feature (126)..(126): Xaa can be any naturally occurring amino acid
  misc_feature (130)..(130): Xaa can be any naturally occurring amino acid
SQTSKMYWFTKTNGRFKEVFKGXIMPREESTYSRHSFLKKMELFNFSKGSCSSFLCLKQGRIKALLHWKXTHCQGXFXIWPTDPNXLPSWLWEPSSSNSLEWLPFLAHXTGNLFLKFXGAWLSSKXKGQXP

SEQ ID NO: 1021 - protein, 222 aa, Homo sapiens
PLEPAVGPKAACPLDSESAEGVVPPASGGGRVQNSPPVGRKTLPLTTAPEAGEVTPSDSGGQEDSPAKGLSVRLEFDYSEDKSSWDNQQENPPPTKKIGKKPVAKMPLRRPKMKKTPEKLDNTPASPPRSPAEPNDIPIAKGTYTFDIDKWDDPNFNPFSSTSKMQESPKLPQQSYNFDPDTCDESVDPFKTSSKPPAHLLNPQPSFEIPASAIGSQWSGPG

SEQ ID NO: 1022 - protein, 249 aa, Homo sapiens
  misc_feature (2)..(11): Xaa can be any naturally occurring amino acid
  misc_feature (14)..(15): Xaa can be any naturally occurring amino acid
  misc_feature (18)..(18): Xaa can be any naturally occurring amino acid
  misc_feature (20)..(20): Xaa can be any naturally occurring amino acid
  misc_feature (23)..(24): Xaa can be any naturally occurring amino acid
  misc_feature (26)..(26): Xaa can be any naturally occurring amino acid
  misc_feature (28)..(32): Xaa can be any naturally occurring amino acid
  misc_feature (34)..(35): Xaa can be any naturally occurring amino acid
  misc_feature (37)..(39): Xaa can be any naturally occurring amino acid
  misc_feature (41)..(43): Xaa can be any naturally occurring amino acid
  misc_feature (45)..(46): Xaa can be any naturally occurring amino acid
  misc_feature (48)..(55): Xaa can be any naturally occurring amino acid
  misc_feature (58)..(59): Xaa can be any naturally occurring amino acid
  misc_feature (61)..(61): Xaa can be any naturally occurring amino acid
  misc_feature (63)..(64): Xaa can be any naturally occurring amino acid
  misc_feature (67)..(67): Xaa can be any naturally occurring amino acid
  misc_feature (70)..(70): Xaa can be any naturally occurring amino acid
  misc_feature (82)..(82): Xaa can be any naturally occurring amino acid
  misc_feature (86)..(86): Xaa can be any naturally occurring amino acid
  misc_feature (90)..(91): Xaa can be any naturally occurring amino acid
  misc_feature (94)..(94): Xaa can be any naturally occurring amino acid
  misc_feature (96)..(96): Xaa can be any naturally occurring amino acid
  misc_feature (109)..(113): Xaa can be any naturally occurring amino acid
  misc_feature (118)..(118): Xaa can be any naturally occurring amino acid
  misc_feature (121)..(122): Xaa can be any naturally occurring amino acid
  misc_feature (125)..(125): Xaa can be any naturally occurring amino acid
  misc_feature (127)..(129): Xaa can be any naturally occurring amino acid
  misc_feature (134)..(134): Xaa can be any naturally occurring amino acid
  misc_feature (136)..(136): Xaa can be any naturally occurring amino acid
  misc_feature (138)..(139): Xaa can be any naturally occurring amino acid
  misc_feature (147)..(147): Xaa can be any naturally occurring amino acid
  misc_feature (149)..(150): Xaa can be any naturally occurring amino acid
  misc_feature (158)..(159): Xaa can be any naturally occurring amino acid
  misc_feature (164)..(164): Xaa can be any naturally occurring amino acid
  misc_feature (166)..(166): Xaa can be any naturally occurring amino acid
  misc_feature (172)..(173): Xaa can be any naturally occurring amino acid
  misc_feature (178)..(178): Xaa can be any naturally occurring amino acid
  misc_feature (180)..(180): Xaa can be any naturally occurring amino acid
  misc_feature (183)..(183): Xaa can be any naturally occurring amino acid
  misc_feature (188)..(188): Xaa can be any naturally occurring amino acid
  misc_feature (190)..(193): Xaa can be any naturally occurring amino acid
  misc_feature (197)..(197): Xaa can be any naturally occurring amino acid
  misc_feature (200)..(200): Xaa can be any naturally occurring amino acid
  misc_feature (206)..(207): Xaa can be any naturally occurring amino acid
  misc_feature (210)..(210): Xaa can be any naturally occurring amino acid
  misc_feature (212)..(214): Xaa can be any naturally occurring amino acid
  misc_feature (216)..(216): Xaa can be any naturally occurring amino acid
  misc_feature (221)..(221): Xaa can be any naturally occurring amino acid
  misc_feature (225)..(228): Xaa can be any naturally occurring amino acid
  misc_feature (231)..(231): Xaa can be any naturally occurring amino acid
  misc_feature (234)..(235): Xaa can be any naturally occurring amino acid
  misc_feature (237)..(237): Xaa can be any naturally occurring amino acid
  misc_feature (241)..(241): Xaa can be any naturally occurring amino acid
  misc_feature (243)..(243): Xaa can be any naturally occurring amino acid
  misc_feature (246)..(246): Xaa can be any naturally occurring amino acid
LXXXXXXXXXXNIXXICXGXQWXXRXNXXXXXHXXLXXXIXXXGXXMXXXXXXXXCMXXCXLXXWQXVWXRQAESACLLIHXCMNXPALXXYSXRXCSFRNAGLVGGLXXXXXASNLXNVXXAPXQXXXRVHLXGXVXXLLLLRLGXTXXCEHTFTHXXILAEXLXRTGPIXXISSIXGXPRXLFHRXLXXXXRLAXFLXKPSLVXXPLXGXXXLXFLGDXPLYXXXXQWXLFXXFXPIFXPXIFXHLY

SEQ ID NO: 1023 - protein, 231 aa, Homo sapiens
  misc_feature (220)..(220): Xaa can be any naturally occurring amino acid
LQRLFEEFRDSDDVLGHIMKNITAKRSRARIVDKLLALGLVAERRELYKKRQKKLASSILPNGAESLKDFCQEDLEEEENLPEEDSEEEEEGGSEAEQVQGSLVLSNENLGQSLHQEGFSIPLLWLQNCLIRAADDREEDGCSQAVPLVPLTEENEEAMENEQFQQLLRKLGVRPPASGQETFWRIPAKLSPTQLRRAAASFESTRGGTETCSQNCSLKXLESKALMKSTC

SEQ ID NO: 1024 - protein, 116 aa, Homo sapiens
  misc_feature (4)..(4): Xaa can be any naturally occurring amino acid
  misc_feature (14)..(14): Xaa can be any naturally occurring amino acid
  misc_feature (30)..(30): Xaa can be any naturally occurring amino acid
  misc_feature (32)..(32): Xaa can be any naturally occurring amino acid
  misc_feature (36)..(36): Xaa can be any naturally occurring amino acid
  misc_feature (47)..(47): Xaa can be any naturally occurring amino acid
  misc_feature (52)..(52): Xaa can be any naturally occurring amino acid
  misc_feature (55)..(55): Xaa can be any naturally occurring amino acid
  misc_feature (58)..(58): Xaa can be any naturally occurring amino acid
  misc_feature (62)..(62): Xaa can be any naturally occurring amino acid
  misc_feature (72)..(72): Xaa can be any naturally occurring amino acid
  misc_feature (82)..(84): Xaa can be any naturally occurring amino acid
  misc_feature (89)..(91): Xaa can be any naturally occurring amino acid
  misc_feature (96)..(96): Xaa can be any naturally occurring amino acid
  misc_feature (100)..(100): Xaa can be any naturally occurring amino acid
  misc_feature (105)..(105): Xaa can be any naturally occurring amino acid
  misc_feature (107)..(107): Xaa can be any naturally occurring amino acid
  misc_feature (110)..(110): Xaa can be any naturally occurring amino acid
  misc_feature (112)..(112): Xaa can be any naturally occurring amino acid
  misc_feature (114)..(115): Xaa can be any naturally occurring amino acid
IREXAWDSTALSSXRSFWVLYDPSNSDLNXPXKNVXISTPRAFLAFXVILNXSLXSGXSVLXLGFLGTSPTXGGSCSLPLNXXXLVPRXXXPTNLXVFWXGFPLXGXFYXTXGXXS

SEQ ID NO: 1025 - protein, 110 aa, Homo sapiens
  misc_feature (7)..(7): Xaa can be any naturally occurring amino acid
  misc_feature (11)..(12): Xaa can be any naturally occurring amino acid
  misc_feature (15)..(15): Xaa can be any naturally occurring amino acid
  misc_feature (19)..(19): Xaa can be any naturally occurring amino acid
  misc_feature (26)..(26): Xaa can be any naturally occurring amino acid
  misc_feature (29)..(29): Xaa can be any naturally occurring amino acid
  misc_feature (31)..(31): Xaa can be any naturally occurring amino acid
  misc_feature (43)..(43): Xaa can be any naturally occurring amino acid
  misc_feature (45)..(47): Xaa can be any naturally occurring amino acid
  misc_feature (49)..(49): Xaa can be any naturally occurring amino acid
  misc_feature (63)..(64): Xaa can be any naturally occurring amino acid
  misc_feature (70)..(71): Xaa can be any naturally occurring amino acid
  misc_feature (84)..(84): Xaa can be any naturally occurring amino acid
  misc_feature (86)..(86): Xaa can be any naturally occurring amino acid
  misc_feature (92)..(92): Xaa can be any naturally occurring amino acid
  misc_feature (102)..(102): Xaa can be any naturally occurring amino acid
  misc_feature (109)..(109): Xaa can be any naturally occurring amino acid
YQTQSKXIHHXXYYXPTLXQMQEWAXIWXLXDDHRKQNEDRGXWXXXKXVQNSRLSCHKAPHXXLRPTSXXKPKEQTNKRGPGXFXYFTHSXYLLRSSNNQXKWFLKKXN

SEQ ID NO: 1026 - protein, 93 aa, Homo sapiens
  misc_feature (2)..(2): Xaa can be any naturally occurring amino acid
  misc_feature (5)..(5): Xaa can be any naturally occurring amino acid
  misc_feature (17)..(18): Xaa can be any naturally occurring amino acid
  misc_feature (24)..(24): Xaa can be any naturally occurring amino acid
  misc_feature (26)..(26): Xaa can be any naturally occurring amino acid
  misc_feature (39)..(39): Xaa can be any naturally occurring amino acid
  misc_feature (42)..(43): Xaa can be any naturally occurring amino acid
  misc_feature (45)..(45): Xaa can be any naturally occurring amino acid
  misc_feature (58)..(59): Xaa can be any naturally occurring amino acid
  misc_feature (62)..(62): Xaa can be any naturally occurring amino acid
  misc_feature (69)..(69): Xaa can be any naturally occurring amino acid
  misc_feature (74)..(74): Xaa can be any naturally occurring amino acid
  misc_feature (77)..(78): Xaa can be any naturally occurring amino acid
  misc_feature (81)..(81): Xaa can be any naturally occurring amino acid
NXESXPDPFYWSVPLAXXWRWVAXPXGELYDMTGGSFVXLLXXTXCLCPHFVSYDHPXXTRXRPIPAFXIGLEXSTXXDEXVCFVFGIKHVRL

SEQ ID NO: 1027 - protein, 205 aa, Homo sapiens
  misc_feature (1)..(1): Xaa can be any naturally occurring amino acid
  misc_feature (3)..(3): Xaa can be any naturally occurring amino acid
XLXSRACRSTLVDPKFETIVEQAPLAIEDLLNELDTQDEEVASDSDESSEGGERGDALSQKRSEKPPAGSICRAEPEAGEEQAGDDRDSGGPVLQFDYEAVANRLFEMASRQSTPSQNRKRLYKVIRKLQDLAGGIFPEDEIPEKACRRLLEGRRQKKTKKQKRLLRLQQERGKGEKEPPSPGMERKRSRRRGVGARPRGAGRGW

SEQ ID NO: 1028 - protein, 161 aa, Homo sapiens
  misc_feature (10)..(10): Xaa can be any naturally occurring amino acid
  misc_feature (16)..(16): Xaa can be any naturally occurring amino acid
  misc_feature (20)..(20): Xaa can be any naturally occurring amino acid
  misc_feature (22)..(22): Xaa can be any naturally occurring amino acid
  misc_feature (66)..(66): Xaa can be any naturally occurring amino acid
  misc_feature (69)..(69): Xaa can be any naturally occurring amino acid
  misc_feature (75)..(75): Xaa can be any naturally occurring amino acid
  misc_feature (80)..(80): Xaa can be any naturally occurring amino acid
AGPASEISPXARGQKXARQXRXTPSAPDQCPSKGGQCPGAGEEEETQGVMWPGQGQAGREARPRLXRGXRLTGLXCRLRXVAPELLCQAGGKGGTGEMGPSLGASIPGTGPFPRASACGCDDLGPEGQTPKTETLPAAGLAAPAVGGSENKMPRSPCQGSV

SEQ ID NO: 1029 - protein, 301 aa, Homo sapiens
  misc_feature (21)..(21): Xaa can be any naturally occurring amino acid
  misc_feature (26)..(26): Xaa can be any naturally occurring amino acid
  misc_feature (32)..(32): Xaa can be any naturally occurring amino acid
  misc_feature (35)..(35): Xaa can be any naturally occurring amino acid
  misc_feature (79)..(79): Xaa can be any naturally occurring amino acid
  misc_feature (81)..(81): Xaa can be any naturally occurring amino acid
  misc_feature (85)..(85): Xaa can be any naturally occurring amino acid
  misc_feature (91)..(91): Xaa can be any naturally occurring amino acid
  misc_feature (105)..(105): Xaa can be any naturally occurring amino acid
WAHLSSAALPSRLAQEFWSHXPESTXQPGQPXPAXQARPGLPPCLSLARPHHSLRFFFFSGSWTLAAFARALVRGRRCXPXLASXFLATGXWADLGSRARSAVPXCSPASARASGSGPYTPPPAPLPLHARARGLLLTFPSLLLQPEQTLLLLRLLLPPPFKQAPAGLLWDLIFRENASCQVLQLPDHFVETLSVLRRGALAAGHFKQSVSNCLVVKLENGAATVPVVTCLLLTSLRFSPADGACGRLLRPLLGQRVSTLTTLRGLITVRRHLLILCVQFIQEVFNGKRGLLHNRLKLWIH

SEQ ID NO: 1030 - protein, 216 aa, Homo sapiens
  misc_feature (48)..(48): Xaa can be any naturally occurring amino acid
  misc_feature (52)..(52): Xaa can be any naturally occurring amino acid
  misc_feature (59)..(59): Xaa can be any naturally occurring amino acid
  misc_feature (62)..(62): Xaa can be any naturally occurring amino acid
  misc_feature (106)..(106): Xaa can be any naturally occurring amino acid
  misc_feature (108)..(108): Xaa can be any naturally occurring amino acid
  misc_feature (112)..(112): Xaa can be any naturally occurring amino acid
  misc_feature (118)..(118): Xaa can be any naturally occurring amino acid
  misc_feature (132)..(132): Xaa can be any naturally occurring amino acid
PSGPRSSQPQAEALGKGPVPGMLAPNDGPISPVPPFPPAWHRSSGATXLSLXNSPVSLXPRXKRGLASLPACPWPGHITPCVSSSSPAPGHWPPLLGHWSGAEGVXLXWRAXFWPRAXGLISEAGPAQLCLXAHQPLPAPRGRAPTPLLLLLFLSMPGLGGSFSPFPLSCCNLSRRFCFFVFFCRLPSSRRLQAFSGISSSGKMPPARSCSFRITL

SEQ ID NO: 1031 - protein, 190 aa, Homo sapiens
FETIVEQAPLAIEDLLNELDTQDEEVASDSDESSEGGERGDALSQKRSEKPPAGSICRAEPEAGEEQAGDDRDSGGPVLQFDYEAVANRLFEMASRQSTPSQNRKRLYKVIRKLQDLAGGIFPEDEIPEKACRRLLEGRRQKKTKKQKRLLRLQQERGKGEKEPPSPGMERKRSRRRGVGARPRGAGRGW

SEQ ID NO: 1032 - protein, 124 aa, Homo sapiens
  misc_feature (14)..(14): Xaa can be any naturally occurring amino acid
  misc_feature (16)..(16): Xaa can be any naturally occurring amino acid
  misc_feature (20)..(20): Xaa can be any naturally occurring amino acid
  misc_feature (26)..(26): Xaa can be any naturally occurring amino acid
  misc_feature (40)..(40): Xaa can be any naturally occurring amino acid
AFWLGHWSGAEGVXLXWRAXFWPRAXGLISEAGPAQLCLXAHQPLPAPRGRAPTPLLLLLFLSMPGLGGSFSPFPLSCCNLSRRFCFFVFFCRLPSSRRLQAFSGISSSGKMPPARSCSFRITL

SEQ ID NO: 1033 - protein, 231 aa, Homo sapiens
  misc_feature (13)..(13): Xaa can be any naturally occurring amino acid
  misc_feature (15)..(15): Xaa can be any naturally occurring amino acid
  misc_feature (19)..(19): Xaa can be any naturally occurring amino acid
  misc_feature (25)..(25): Xaa can be any naturally occurring amino acid
  misc_feature (39)..(39): Xaa can be any naturally occurring amino acid
LLARALVRGRRCXPXLASXFLATGXWADLGSRARSAVPXCSPASARASGSGPYTPPPAPLPLHARARGLLLTFPSLLLQPEQTLLLLRLLLPPPFKQAPAGLLWDLIFRENASCQVLQLPDHFVETLSVLRRGALAAGHFKQSVSNCLVVKLENGAATVPVVTCLLLTSLRFSPADGACGRLLRPLLGQRVSTLTTLRGLITVRRHLLILCVQFIQEVFNGKRGLLHNRLK

SEQ ID NO: 1034 - protein, 149 aa, Homo sapiens
  misc_feature (21)..(21): Xaa can be any naturally occurring amino acid
  misc_feature (26)..(26): Xaa can be any naturally occurring amino acid
  misc_feature (32)..(32): Xaa can be any naturally occurring amino acid
  misc_feature (35)..(35): Xaa can be any naturally occurring amino acid
  misc_feature (101)..(101): Xaa can be any naturally occurring amino acid
  misc_feature (110)..(110): Xaa can be any naturally occurring amino acid
  misc_feature (127)..(127): Xaa can be any naturally occurring amino acid
  misc_feature (139)..(139): Xaa can be any naturally occurring amino acid
  misc_feature (142)..(142): Xaa can be any naturally occurring amino acid
  misc_feature (145)..(145): Xaa can be any naturally occurring amino acid
WAHLSSAALPSRLAQEFWSHXPESTXQPGQPXPAXQARPGLPPCLSLARPHHSLRFFFFSGSWTLAAFARALVRGRGVLLLLASPSLATAPGLISEQGPLXCAWLFTKPXARASGVGPLTPLPPGYXFPLHAPGLRGGXLFXPFXFFSL

SEQ ID NO: 1035 - protein, 126 aa, Homo sapiens
  misc_feature (3)..(3): Xaa can be any naturally occurring amino acid
  misc_feature (9)..(9): Xaa can be any naturally occurring amino acid
  misc_feature (12)..(12): Xaa can be any naturally occurring amino acid
  misc_feature (78)..(78): Xaa can be any naturally occurring amino acid
  misc_feature (87)..(87): Xaa can be any naturally occurring amino acid
  misc_feature (105)..(105): Xaa can be any naturally occurring amino acid
  misc_feature (117)..(117): Xaa can be any naturally occurring amino acid
  misc_feature (119)..(119): Xaa can be any naturally occurring amino acid
  misc_feature (122)..(122): Xaa can be any naturally occurring amino acid
VYXTARSAXSRXASEAWPPSLPVLGPATSLPAFLLLLRLLDIGRLCSGTGQGPRCPPSSGEPLFGHGPWADLGAGPAXLCLAVHQTXCPRLGGRAPNTPSSWVPXSSSCPGASGGPXFXPFXLFFP

SEQ ID NO: 1036 - protein, 179 aa, Homo sapiens
  misc_feature (9)..(9): Xaa can be any naturally occurring amino acid
  misc_feature (18)..(18): Xaa can be any naturally occurring amino acid
  misc_feature (84)..(84): Xaa can be any naturally occurring amino acid
  misc_feature (87)..(87): Xaa can be any naturally occurring amino acid
  misc_feature (93)..(93): Xaa can be any naturally occurring amino acid
  misc_feature (98)..(98): Xaa can be any naturally occurring amino acid
GPDPRGAGXRFGEQPGTXERALLRDQPRGRGQRGARQKKEDTSAPDQCPSKGGQCPGAGEEEETQGVMWPGQGQAGREARPRLXRGXRLTGLXCRLRXVAPELLCQAGGKGGTGEMGPSLGASIPGTGPFPRASACGCDDLGPEGQTPKTETLPAAGLAAPAVGGSENKMPRSPCQGSV

SEQ ID NO: 1037 - protein, 156 aa, Homo sapiens
SEETLPKANPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQVSGMGEMG

SEQ ID NO: 1038 - protein, 169 aa, Homo sapiens
NCKRAHQRFMVDYPISPIPLTCPFPGLDMVLRARWTLGCPSGLVVAGGGSDPAAAAPWAPGILSSLIAKLWTDGGDFPAPVIDILARLGQEPPLLGEEGNDFVAWPSRIRPPRRSPSPSRFSDSSPMSGVAPTGVSAPSSPTVTVTEAGDEGPAGSRESGLALGRVSSL

SEQ ID NO: 1039 - protein, 67 aa, Homo sapiens
  misc_feature (12)..(12): Xaa can be any naturally occurring amino acid
  misc_feature (14)..(14): Xaa can be any naturally occurring amino acid
  misc_feature (16)..(17): Xaa can be any naturally occurring amino acid
  misc_feature (22)..(22): Xaa can be any naturally occurring amino acid
  misc_feature (32)..(32): Xaa can be any naturally occurring amino acid
  misc_feature (37)..(37): Xaa can be any naturally occurring amino acid
  misc_feature (39)..(39): Xaa can be any naturally occurring amino acid
  misc_feature (46)..(46): Xaa can be any naturally occurring amino acid
  misc_feature (48)..(48): Xaa can be any naturally occurring amino acid
  misc_feature (50)..(50): Xaa can be any naturally occurring amino acid
  misc_feature (57)..(58): Xaa can be any naturally occurring amino acid
  misc_feature (65)..(65): Xaa can be any naturally occurring amino acid
GNGMEKMEYPPXNXLXXFFTVXLKGFYSIYSXPIFKXRXCCVSKIXLXLXLEPTTGXXFLQVYIXGW

SEQ ID NO: 1040 - protein, 70 aa, Homo sapiens
GSFQSRANSYAVCPESACFFSISSRHPIFFSFKNLLVGWLWWLAPVIPALCEVKAGRLLKPSSLRPAWAT

SEQ ID NO: 1041 - protein, 50 aa, Homo sapiens
RIEEDNLTYQHLLPESPEPSASHALSDYETSEKSFFSRDQKQDNETEKTS

SEQ ID NO: 1042 - protein, 121 aa, Homo sapiens
VMVNSFSQDLLMEHIQEIRTLRKRLEESIKTNEKLRKQLERQGSEFVQGSTSIFASGSELHSSLTSEIHFLRKQNQALNAMLIKGSRDKQKENDKLRESLSRKTVSLEHLQREYASREGRK

SEQ ID NO: 1043 - protein, 148 aa, Homo sapiens
  misc_feature (5)..(5): Xaa can be any naturally occurring amino acid
  misc_feature (14)..(14): Xaa can be any naturally occurring amino acid
  misc_feature (22)..(23): Xaa can be any naturally occurring amino acid
  misc_feature (27)..(27): Xaa can be any naturally occurring amino acid
  misc_feature (32)..(32): Xaa can be any naturally occurring amino acid
  misc_feature (36)..(36): Xaa can be any naturally occurring amino acid
  misc_feature (39)..(40): Xaa can be any naturally occurring amino acid
  misc_feature (49)..(49): Xaa can be any naturally occurring amino acid
  misc_feature (51)..(51): Xaa can be any naturally occurring amino acid
  misc_feature (53)..(53): Xaa can be any naturally occurring amino acid
  misc_feature (58)..(59): Xaa can be any naturally occurring amino acid
  misc_feature (61)..(61): Xaa can be any naturally occurring amino acid
  misc_feature (72)..(72): Xaa can be any naturally occurring amino acid
  misc_feature (82)..(82): Xaa can be any naturally occurring amino acid
  misc_feature (94)..(94): Xaa can be any naturally occurring amino acid
  misc_feature (97)..(97): Xaa can be any naturally occurring amino acid
  misc_feature (104)..(105): Xaa can be any naturally occurring amino acid
CPSCXLNLVFQKGXGFQRPLSXXQAQXPGFPXQKAXPGXXKDPAPFKPXSXRXFQVSXXFXPSFSYAFSSTXKDCKSLSFCXAAAASTSAPPAXCQXLAAAADXXDQLLVGLSFSLPSFCSLSFSSFTAGILPLKVLQAHGLPGEGLS

SEQ ID NO: 1044 - protein, 160 aa, Homo sapiens
  misc_feature (5)..(5): Xaa can be any naturally occurring amino acid
  misc_feature (13)..(13): Xaa can be any naturally occurring amino acid
  misc_feature (21)..(22): Xaa can be any naturally occurring amino acid
  misc_feature (26)..(26): Xaa can be any naturally occurring amino acid
  misc_feature (31)..(31): Xaa can be any naturally occurring amino acid
  misc_feature (35)..(35): Xaa can be any naturally occurring amino acid
  misc_feature (39)..(39): Xaa can be any naturally occurring amino acid
  misc_feature (49)..(50): Xaa can be any naturally occurring amino acid
  misc_feature (53)..(53): Xaa can be any naturally occurring amino acid
  misc_feature (58)..(58): Xaa can be any naturally occurring amino acid
  misc_feature (61)..(61): Xaa can be any naturally occurring amino acid
  misc_feature (72)..(72): Xaa can be any naturally occurring amino acid
  misc_feature (81)..(81): Xaa can be any naturally occurring amino acid
  misc_feature (94)..(94): Xaa can be any naturally occurring amino acid
  misc_feature (96)..(96): Xaa can be any naturally occurring amino acid
  misc_feature (103)..(104): Xaa can be any naturally occurring amino acid
PKLSXKPCFPKGXRVSKAPFXXPSPXAWFSXPEGXARSXKGSCPFQAFXXTPXSSFLXFSXQLFIRLQLHSXRLQKLVILXSSCCLNFSSSCTXSXPGRCSGXXGSAAGWSLLLAAFFLQPFIFFLHGWHTPAEGAPGSRSSWRGTLVICHSPSVYLWIL

SEQ ID NO: 1045 - protein, 143 aa, Homo sapiens
  misc_feature (50)..(50): Xaa can be any naturally occurring amino acid
NDIQTQEAPSSTSQELGTKGPHPAPLSKFVSSVSTAKLTLEEAYRRLKLXWRVSLPEDGQCPLHCEQIGEMKAEVTKLHKKLFEQEKKLQNTMKLLQLSKRQEKVIFDQLVVTHKILRKARGNLELRPGGAHPGTCSPSRPGS

SEQ ID NO: 1046 - protein, 103 aa, Homo sapiens
  misc_feature (23)..(23): Xaa can be any naturally occurring amino acid
  misc_feature (25)..(25): Xaa can be any naturally occurring amino acid
  misc_feature (38)..(39): Xaa can be any naturally occurring amino acid
  misc_feature (56)..(56): Xaa can be any naturally occurring amino acid
  misc_feature (58)..(58): Xaa can be any naturally occurring amino acid
  misc_feature (73)..(73): Xaa can be any naturally occurring amino acid
  misc_feature (77)..(77): Xaa can be any naturally occurring amino acid
  misc_feature (80)..(80): Xaa can be any naturally occurring amino acid
  misc_feature (82)..(82): Xaa can be any naturally occurring amino acid
  misc_feature (84)..(84): Xaa can be any naturally occurring amino acid
  misc_feature (87)..(87): Xaa can be any naturally occurring amino acid
  misc_feature (89)..(89): Xaa can be any naturally occurring amino acid
MSFQQGASALADLFEQGLIVLNXAXDMAAFLLAHRWWXXPGGTHTGVLIGRTATVXEXGVRVIPKKWRSSETXFGVXGWXEXNXIKXNXLSMGIFGTHPVCQG

SEQ ID NO: 1047 - protein, 178 aa, Homo sapiens
ENLKQQLEEQEYKLQKEQNLNMQLFSEIHNLQNKFRDLSPPRYDSLVQSQARELSLQRQQIKDGHGICVISRQHMNTMIKAFEELLQASDVDYCVAEGFQEQLNQCAELLEKLEKLFLNGKSVGVEMNTQNELMERIEEDNLTYQHLLPESPEPSASHALSDYETSEKSFFSRDQKPR

SEQ ID NO: 1048 - protein, 141 aa, Homo sapiens
HSNPRGSQLHKSRAGNKGSTPSTIEQVCEQCEHGQADPGRGLQRLKLLWRVSLPEDGQCPLHCEQIGEMKAEVTKLHKKLFEQEKKLQNTMKLLQLSKRQEKVIFDQLVVTHKILRKARGNLELRPGGAHPGTCSPSRPGS

SEQ ID NO: 1049 - protein, 135 aa, Homo sapiens
  misc_feature (4)..(4): Xaa can be any naturally occurring amino acid
  misc_feature (23)..(23): Xaa can be any naturally occurring amino acid
  misc_feature (27)..(27): Xaa can be any naturally occurring amino acid
  misc_feature (37)..(37): Xaa can be any naturally occurring amino acid
  misc_feature (39)..(39): Xaa can be any naturally occurring amino acid
  misc_feature (57)..(58): Xaa can be any naturally occurring amino acid
  misc_feature (66)..(66): Xaa can be any naturally occurring amino acid
  misc_feature (70)..(70): Xaa can be any naturally occurring amino acid
  misc_feature (76)..(76): Xaa can be any naturally occurring amino acid
  misc_feature (79)..(79): Xaa can be any naturally occurring amino acid
  misc_feature (81)..(81): Xaa can be any naturally occurring amino acid
  misc_feature (84)..(84): Xaa can be any naturally occurring amino acid
  misc_feature (88)..(88): Xaa can be any naturally occurring amino acid
  misc_feature (99)..(101): Xaa can be any naturally occurring amino acid
  misc_feature (103)..(103): Xaa can be any naturally occurring amino acid
  misc_feature (108)..(108): Xaa can be any naturally occurring amino acid
  misc_feature (112)..(112): Xaa can be any naturally occurring amino acid
  misc_feature (121)..(122): Xaa can be any naturally occurring amino acid
  misc_feature (124)..(124): Xaa can be any naturally occurring amino acid
  misc_feature (126)..(126): Xaa can be any naturally occurring amino acid
  misc_feature (128)..(128): Xaa can be any naturally occurring amino acid
  misc_feature (130)..(130): Xaa can be any naturally occurring amino acid
  misc_feature (133)..(133): Xaa can be any naturally occurring amino acid
SSIXPKTWRPFLLAHKVVANDQXGHTXSASCRTATVXRXGNPCHFQKSGGVSETEFXXHWPGRNQXDQMXYPFHGXICXIXFVXLKGXLRDGHRLGKPXXXLXLGLFXPLAXVLEPVLKRXXFXPXLXAXQTXFH

SEQ ID NO: 1050 - protein, 218 aa, Homo sapiens
  misc_feature (203)..(203): Xaa can be any naturally occurring amino acid
  misc_feature (212)..(212): Xaa can be any naturally occurring amino acid
  misc_feature (216)..(216): Xaa can be any naturally occurring amino acid
GVPGWQAALLSLPGITNREAKKSRLPILIKPSRSLGNMYRLPATQEVVTQLQSQILELQGELKEFKTCNKQLHQKLILAEAVMEGRPTPDKTLLNAQPPVGAAYQDSPGEQKGIKTTSSVWRDKEMDSDQQRSYEIDSEICPPDDLASLPSCKENPEDVLSPTSVATYLSSKSQPSAKVSVMGTDQSESINTSNETEYLKQKXHDLGNWNLXRLPXIS

SEQ ID NO: 1051 - protein, 96 aa, Homo sapiens
  misc_feature (2)..(3): Xaa can be any naturally occurring amino acid
  misc_feature (10)..(10): Xaa can be any naturally occurring amino acid
  misc_feature (16)..(17): Xaa can be any naturally occurring amino acid
  misc_feature (29)..(29): Xaa can be any naturally occurring amino acid
  misc_feature (45)..(45): Xaa can be any naturally occurring amino acid
SXXWRVSLPXDGQCPXXCEQIGEMKAEVXKLHKKLFEQEKKLQNXMKLLQLSKRQEKVIFDQLVVTHKILRKARGNLELRPGGAHPGTCSPSRPGS

SEQ ID NO: 1052 - protein, 106 aa, Homo sapiens
  misc_feature (17)..(17): Xaa can be any naturally occurring amino acid
  misc_feature (33)..(33): Xaa can be any naturally occurring amino acid
  misc_feature (45)..(46): Xaa can be any naturally occurring amino acid
  misc_feature (52)..(52): Xaa can be any naturally occurring amino acid
  misc_feature (58)..(59): Xaa can be any naturally occurring amino acid
  misc_feature (62)..(62): Xaa can be any naturally occurring amino acid
  misc_feature (66)..(66): Xaa can be any naturally occurring amino acid
  misc_feature (68)..(69): Xaa can be any naturally occurring amino acid
  misc_feature (78)..(78): Xaa can be any naturally occurring amino acid
  misc_feature (84)..(85): Xaa can be any naturally occurring amino acid
  misc_feature (87)..(89): Xaa can be any naturally occurring amino acid
  misc_feature (95)..(95): Xaa can be any naturally occurring amino acid
  misc_feature (99)..(99): Xaa can be any naturally occurring amino acid
  misc_feature (102)..(102): Xaa can be any naturally occurring amino acid
SKMTFSWRLLSCKSFMXFCNFFSCSNNFLCSLXTSAFISPICSQXXGHWPSXGSETLXXKLXPAVXPXXRVSWAGSHXLQTCLXXAXXXALWFQXLTLXNWXPFWG

SEQ ID NO: 1053 - protein, 219 aa, Homo sapiens
  misc_feature (212)..(212): Xaa can be any naturally occurring amino acid
CLDFSKADSGVHLCVIDDSNEHMLTVWDWQRKAKGAEIKTTNEVVLAVEFHPTDANTIITCGKSHIFFWTWSGNSLTRKQGIFGKYEKPKFVQCLAFLGNGDVLTGDSGGVMLIWSKTTVEPTPGKGPKGVYQISKQIKAHDGSVFTLCQMRNGMLLTGGGKDRKIILWDHDLNPEREIEGPDQYGTIRAVAEGKGRSIFSRPHHRNFILRXNHFNDGL

SEQ ID NO: 1054 - protein, 126 aa, Homo sapiens
  misc_feature (3)..(3): Xaa can be any naturally occurring amino acid
  misc_feature (7)..(8): Xaa can be any naturally occurring amino acid
  misc_feature (30)..(31): Xaa can be any naturally occurring amino acid
  misc_feature (42)..(42): Xaa can be any naturally occurring amino acid
  misc_feature (44)..(44): Xaa can be any naturally occurring amino acid
  misc_feature (51)..(51): Xaa can be any naturally occurring amino acid
  misc_feature (59)..(59): Xaa can be any naturally occurring amino acid
  misc_feature (65)..(65): Xaa can be any naturally occurring amino acid
  misc_feature (69)..(69): Xaa can be any naturally occurring amino acid
  misc_feature (72)..(74): Xaa can be any naturally occurring amino acid
PRXFSTXXFPPLYERFGVCLKGQGNPLWVXXNKKICPPLKIXRXISYGEKXSEILPFGXHLLKTXKIVXFKXXXDSKHPIFLQYVCSVHTYRSAPVSIRHIYLSVSNDYYIIRSACAILPARNILT

SEQ ID NO: 1055 - protein, 72 aa, Homo sapiens
  misc_feature (9)..(9): Xaa can be any naturally occurring amino acid
  misc_feature (12)..(12): Xaa can be any naturally occurring amino acid
  misc_feature (18)..(18): Xaa can be any naturally occurring amino acid
  misc_feature (26)..(27): Xaa can be any naturally occurring amino acid
  misc_feature (32)..(32): Xaa can be any naturally occurring amino acid
  misc_feature (36)..(36): Xaa can be any naturally occurring amino acid
  misc_feature (39)..(41): Xaa can be any naturally occurring amino acid
KNMPPVKNXQGXLLWGKXIGNPSLWXXPVKNXQNSXFQXXXRFQAPHLSSVCMFCTYLSERASKYQAYISVC

SEQ ID NO: 1056 - protein, 206 aa, Homo sapiens
  misc_feature (104)..(104): Xaa can be any naturally occurring amino acid
  misc_feature (190)..(190): Xaa can be any naturally occurring amino acid
  misc_feature (196)..(196): Xaa can be any naturally occurring amino acid
  misc_feature (206)..(206): Xaa can be any naturally occurring amino acid
MLLTGGGKDRKIILWDHDLNPEREIEVPDQYGTIRAVAEGKADQFLVGTSRNFILRGTFNDGFQIEVQGHTDELWGLATHPFKDLLLTCAQDRQVCLWNSMEHXLEWTRLVDEPGHCADFHPSGTVVAIGTHSGRWFVLDAETRDLVSIHTDGNEQLSVMRYSIDGTFLAVGSHDNFIYLYVVSENGRKXSRYGRXTGHSSYITHX

SEQ ID NO: 1057 - protein, 70 aa, Homo sapiens
  misc_feature (4)..(4): Xaa can be any naturally occurring amino acid
  misc_feature (8)..(8): Xaa can be any naturally occurring amino acid
  misc_feature (15)..(15): Xaa can be any naturally occurring amino acid
  misc_feature (18)..(20): Xaa can be any naturally occurring amino acid
  misc_feature (25)..(25): Xaa can be any naturally occurring amino acid
EDMXHVEXLSEISMXIGXXXLPFGXQLLKTLKIVLFKRREIPSNPSFFSMYVLTYLSERASKYQAYISVC

SEQ ID NO: 1058 - protein, 99 aa, Homo sapiens
  misc_feature (39)..(39): Xaa can be any naturally occurring amino acid
  misc_feature (44)..(45): Xaa can be any naturally occurring amino acid
  misc_feature (49)..(49): Xaa can be any naturally occurring amino acid
  misc_feature (56)..(56): Xaa can be any naturally occurring amino acid
  misc_feature (60)..(60): Xaa can be any naturally occurring amino acid
  misc_feature (74)..(74): Xaa can be any naturally occurring amino acid
  misc_feature (85)..(85): Xaa can be any naturally occurring amino acid
  misc_feature (87)..(87): Xaa can be any naturally occurring amino acid
  misc_feature (89)..(89): Xaa can be any naturally occurring amino acid
  misc_feature (92)..(92): Xaa can be any naturally occurring amino acid
  misc_feature (94)..(94): Xaa can be any naturally occurring amino acid
YLLARSDKYVRTYILKKDGLLGISLLLKRTILRVFNSCXPKGRXXDPIXIEISLSXSTWXISSYLKKHTVFSLXPLNTPTPFHYXGXKXMVXNXPWEVT

SEQ ID NO: 1059 - protein, 219 aa, Homo sapiens
  misc_feature (194)..(194): Xaa can be any naturally occurring amino acid
  misc_feature (214)..(214): Xaa can be any naturally occurring amino acid
FLQPLQPHVRVWDSVTLSTLQIIGLGTFERGVGCLDFSKADSGVHLCVIDDSNEHMLTVWDWQRKAKGAEIKTTNEVVLAVEFHPTDANTIITCGKSHIFFWTWSGNSLTRKQGIFGKYEKPKFVQCLAFLGNGDVLTGDSGGVMLIWSKTTVEPTPGKGPKGVYQISKQIKAHDGSVFTLCQMRNGMLLTGGXKDRKIILWDHDLNPERRNRXSWISM

SEQ ID NO: 1060 - protein, 69 aa, Homo sapiens
LLHHQISMCYTPCKKYTDMNRQFLEKKEHFFKYLGNTALSDQQGVYLRTSVTFGVAMYNEIYNHDTLRW

SEQ ID NO: 1061 - protein, 86 aa, Homo sapiens
  misc_feature (3)..(3): Xaa can be any naturally occurring amino acid
  misc_feature (18)..(18): Xaa can be any naturally occurring amino acid
  misc_feature (27)..(27): Xaa can be any naturally occurring amino acid
  misc_feature (30)..(31): Xaa can be any naturally occurring amino acid
  misc_feature (33)..(33): Xaa can be any naturally occurring amino acid
  misc_feature (45)..(45): Xaa can be any naturally occurring amino acid
  misc_feature (50)..(50): Xaa can be any naturally occurring amino acid
  misc_feature (59)..(59): Xaa can be any naturally occurring amino acid
RGXWKPLCVSLDKKICTXVENTQCRSXCGXXIXISFPFGLPLLKXLKIVXFQKKRDSKXPIFLQYVCSCTYLSERASKYQAYISVC

SEQ ID NO: 1062 - protein, 200 aa, Homo sapiens
LARSADRRASTDLTRKMKPDETPMFDPSLLKEVDWSQNTATFSPAISPTHPGEGLVLRPLCTADLNRGFFKVLGQLTETGVVSPEQFMKSFEHMKKSGDYYVTVVEDVTLGQIVATATLIIEHKFIHSCAKRGRVEDVVVSDECRGKQLGKLLLSTLTLLSKKLNCYKITLECLPQNVGFYKKFGYTVSEENYMCRRFLK

SEQ ID NO: 1063 - protein, 110 aa, Homo sapiens
  misc_feature (32)..(32): Xaa can be any naturally occurring amino acid
  misc_feature (36)..(36): Xaa can be any naturally occurring amino acid
  misc_feature (42)..(42): Xaa can be any naturally occurring amino acid
  misc_feature (44)..(44): Xaa can be any naturally occurring amino acid
  misc_feature (73)..(73): Xaa can be any naturally occurring amino acid
  misc_feature (77)..(77): Xaa can be any naturally occurring amino acid
  misc_feature (82)..(83): Xaa can be any naturally occurring amino acid
  misc_feature (91)..(91): Xaa can be any naturally occurring amino acid
  misc_feature (95)..(95): Xaa can be any naturally occurring amino acid
YVGNNTPLSVLRCFFETKIFNFMHVINSLIQXYFFXMSHPDXDXYFLLPILLTPKKGSQLLEKYHAGKDQVKXFSLXKNIPXXIHWKLNPXGPPXQESLKAFSWGFQGFP

SEQ ID NO: 1064 - protein, 266 aa, Homo sapiens
VAASLLAPLLPEGIKEEEERWRRKVICKEEPVSEVKETSTTVEEATTIVKPQEIMLDNIEDPSQEDLCSVVQSGESEEEEEQDTLELELVLERKKAELRALEEGDGSVSGSSPRSDISQPASQDGMRRLMSKRGKWKMFVRATSPESTSRSSSKTGRDTPENGETAIGAENSEKIDENSDKEMEVEESSEKIKVQTTPKVEEEQDLKFQIGELANTLPSKFRVSSINRQSIFNFHVLLFQTGTRIATGGKGLLMTLNENFRMQQNN

SEQ ID NO: 1065 - protein, 114 aa, Homo sapiens
DLPMHNRVSSFINEGTQSPRTLISLPKKRTTKFVKGDSSPLGPWNSHFIFLISNTVKAKERERIWELKNKRAKISNNEKKIKKSQIYKEMFSSDLLAEDSNLVLHSHLQPRSFP

SEQ ID NO: 1066 - protein, 276 aa, Homo sapiens
  misc_feature (200)..(201): Xaa can be any naturally occurring amino acid
  misc_feature (230)..(230): Xaa can be any naturally occurring amino acid
  misc_feature (249)..(249): Xaa can be any naturally occurring amino acid
  misc_feature (252)..(252): Xaa can be any naturally occurring amino acid
  misc_feature (255)..(255): Xaa can be any naturally occurring amino acid
  misc_feature (266)..(266): Xaa can be any naturally occurring amino acid
  misc_feature (269)..(269): Xaa can be any naturally occurring amino acid
  misc_feature (274)..(274): Xaa can be any naturally occurring amino acid
VAASLLAPLLPEGIKEEEERWRRKVICKEEPVSEVKETSTTVEEATTIVKPQEIMLDNIEDPSQEDLCSVVQSGESEEEEEQDTLELELVLERKKAELRALEEGDGSVSGSSPRSDISQPASQDGMRRLMSKRGKWKMFVRATSPESTSRSSSKTGRDTPENGETAIGAENSEKIDENSDKEMEVEESSEKIKVQTTPKXXEEQDLKFQIGELANTLPSKFRVSSINRQXIFNFHVLLFQTGTRIATGXKGXFMXTTLTKTLGCPXTTXPFEIXPS

SEQ ID NO: 1067 - protein, 114 aa, Homo sapiens; identical to SEQ ID NO: 1065

SEQ ID NO: 1068 - protein, 87 aa, Homo sapiens
RTRLLSSASRSDENISLYIWLFLIFFSLFEIFALLFFSSQILSLSLAFTVFDIKNMKCEFHGPRGEESPFTNFVVLFFGREISVLGD

SEQ ID NO: 1069 - protein, 265 aa, Homo sapiens
  misc_feature (200)..(200): Xaa can be any naturally occurring amino acid
  misc_feature (239)..(240): Xaa can be any naturally occurring amino acid
  misc_feature (245)..(245): Xaa can be any naturally occurring amino acid
  misc_feature (249)..(249): Xaa can be any naturally occurring amino acid
  misc_feature (253)..(253): Xaa can be any naturally occurring amino acid
  misc_feature (259)..(259): Xaa can be any naturally occurring amino acid
VTKLSVKDRLGFVSKPSVSATEKVLSTSTGLTKTVYNPAALKAAQKTLLVSTSAVDNNEAQKKKQEALKLQQDVRKRKQEILEKHIETQKMLISKLEKNKTMKSEDKAEIMKTLEVLTKNITKLKDEVKAASPGRCLPKSIKTKTQMQKELLDTELDLYKKMQAGEEVTELRRKYTELQLEAAKRGILSSGRGRGIHSRXRGAVHGRSRGRRPRPSVPGMLWWIPSKALEISALPGAIXXIFFLXAQIXEIEXGKIGDXHFMPNY

SEQ ID NO: 1070 - protein, 27 aa, Homo sapiens
VLMHPDVIIKWNGLFKKKKGKKREKQC

SEQ ID NO: 1071 - protein, 63 aa, Homo sapiens
  misc_feature (17)..(17): Xaa can be any naturally occurring amino acid
  misc_feature (19)..(19): Xaa can be any naturally occurring amino acid
  misc_feature (28)..(28): Xaa can be any naturally occurring amino acid
  misc_feature (47)..(47): Xaa can be any naturally occurring amino acid
  misc_feature (56)..(56): Xaa can be any naturally occurring amino acid
  misc_feature (61)..(61): Xaa can be any naturally occurring amino acid
QLFTEVKCKHQSFKIKXRXEVSSFLAIXEIHLHPFYQKLFLQICKSXLDNLMKHRXRSSYXDQ

SEQ ID NO: 1072 - protein, 190 aa, Homo sapiens
NTSLVIDETLLEQGQLDTPGVHNVTALSNLITWQKVDYDFSYHQMEFPCNINVFITSEGRSLLPADCQIHLQPQLIPPNMEEYMNSLLSAVLPSVLNKFRIYLTLLRFLEYSISDEITKAVEDDFVEMRKNDPQSITADDLHQLLVVARCLSLSAGQTTLSRERWLRAKQLESLRRTRLQQQKCVNGNEL

SEQ ID NO: 1073 - protein, 71 aa, Homo sapiens
LLIWDVLFIGKVLSRELFCKTKQCMYFSLVNYNLHWHKKHMVTNVLCSRTIKENVFYPHKSSEAFILFLKV

SEQ ID NO: 1074 - protein, 71 aa, Homo sapiens
  misc_feature (14)..(14): Xaa can be any naturally occurring amino acid
  misc_feature (20)..(20): Xaa can be any naturally occurring amino acid
  misc_feature (22)..(22): Xaa can be any naturally occurring amino acid
  misc_feature (30)..(30): Xaa can be any naturally occurring amino acid
  misc_feature (35)..(35): Xaa can be any naturally occurring amino acid
  misc_feature (37)..(38): Xaa can be any naturally occurring amino acid
  misc_feature (40)..(40): Xaa can be any naturally occurring amino acid
  misc_feature (42)..(42): Xaa can be any naturally occurring amino acid
  misc_feature (50)..(50): Xaa can be any naturally occurring amino acid
  misc_feature (55)..(55): Xaa can be any naturally occurring amino acid
  misc_feature (57)..(57): Xaa can be any naturally occurring amino acid
LADLTYFGTTDDPXKNAQNXIXSKHLMTFXKIKLXKXXMXFXVPILFHIXAQLCXPXFPLHGSQMPWDWEK

SEQ ID NO: 1075 - protein, 214 aa, Homo sapiens
  misc_feature (122)..(122): Xaa can be any naturally occurring amino acid
  misc_feature (175)..(175): Xaa can be any naturally occurring amino acid
  misc_feature (204)..(204): Xaa can be any naturally occurring amino acid
  misc_feature (206)..(206): Xaa can be any naturally occurring amino acid
  misc_feature (209)..(209): Xaa can be any naturally occurring amino acid
CSEKAAPHKAEGLEEADTGASGCHSHPEEQPTSISPSRHGALAELCPPGGSHRMALGTAAALGSNVIRNEQLPLQYLADVDTSDEESIRAHVMASHHSKRRGRASSESQGLGAGVRTEADVXEEALRRKLEELTSNVSDQETSSEEEEAKDEKAEPNRDKSVGPLPQADPEVGTXAIKPTDRKKAPRTLGTPSVNRTTDEELSXLXDRXAIDRL

SEQ ID NO: 1076 - protein, 111 aa, Homo sapiens
  misc_feature (42)..(42): Xaa can be any naturally occurring amino acid
  misc_feature (71)..(71): Xaa can be any naturally occurring amino acid
  misc_feature (73)..(73): Xaa can be any naturally occurring amino acid
  misc_feature (75)..(75): Xaa can be any naturally occurring amino acid
  misc_feature (84)..(84): Xaa can be any naturally occurring amino acid
  misc_feature (88)..(88): Xaa can be any naturally occurring amino acid
  misc_feature (90)..(90): Xaa can be any naturally occurring amino acid
  misc_feature (93)..(93): Xaa can be any naturally occurring amino acid
  misc_feature (97)..(97): Xaa can be any naturally occurring amino acid
PATSVTRRPRPRRRKPRTKRQSPTGTNQLGLSPRRTRRWARXPSNQQTGKKPPGPWGPRQSTGPQMRSCQXWXTXWQLTGFKSXTGKXSXVFXTFEXKDCNPLRAPRASTG

SEQ ID NO: 1077 - protein, 236 aa, Homo sapiens
  misc_feature (200)..(200): Xaa can be any naturally occurring amino acid
  misc_feature (216)..(216): Xaa can be any naturally occurring amino acid
AFLASLERGRRIIDRTLRTLGPSDMFPAEVAWSLSLCGDLGLPLDMVELMLEEKGVQLDSAGLERLAQEEAQHRARQAEPVQKQGLWLDVHALGELQRQGVPPTDDSPKYNYSLRPSGSYEFGTCEAQVLQLYTEDGTAVASVGKGQRCGLLLDRTNFYAEQGGQASDRGYLVRAGQEDVLFPVARAQVCGGFILHEAIXPECLRLGDQVQLHVDXAWRLSCMAKHTGTHLAELGT

SEQ ID NO: 1078 - protein, 125 aa, Homo sapiens
TPLDWSGWPKRRPSTGHGRLSQFRSRDCGLMSMRLGSCSAKECPQLTTAPSTTTPCDPAEVMSSAPVRPRCCNCIQRTGQQWPPWGKASAVASSWTGPTSTQNRGARLQTVATWCGQGKRTCCSQ

SEQ ID NO: 1079 - protein, 180 aa, Homo sapiens
NLHRPGPGLLGTARPLALPAPGSHGLKPGPPVLRRSWSCPRGGHSAGLSPRRPLLSRPLYTVATPGPHRCRTHNFRWVAGSSCTWGCRQLGALLGAAAPQAHGHQATIPASELAQPAVPGAGPPLGPTAPVQRSLAGPLSPPASALPCPRGVPGLHTVTRTRPLQQGTYLKAPGSSESDQ

SEQ ID NO: 1080 - protein, 137 aa, Homo sapiens
  misc_feature (5)..(5): Xaa can be any naturally occurring amino acid
  misc_feature (8)..(8): Xaa can be any naturally occurring amino acid
  misc_feature (12)..(12): Xaa can be any naturally occurring amino acid
  misc_feature (21)..(21): Xaa can be any naturally occurring amino acid
  misc_feature (23)..(23): Xaa can be any naturally occurring amino acid
  misc_feature (32)..(32): Xaa can be any naturally occurring amino acid
  misc_feature (44)..(44): Xaa can be any naturally occurring amino acid
  misc_feature (65)..(66): Xaa can be any naturally occurring amino acid
  misc_feature (78)..(78): Xaa can be any naturally occurring amino acid
  misc_feature (80)..(80): Xaa can be any naturally occurring amino acid
  misc_feature (93)..(93): Xaa can be any naturally occurring amino acid
TRAPXATXWGFXIQAPQGPMXKXFLLCPFQGXPRVPIAPPFHNXRAWGTGKCSKPPIGGPRAWGXXKWWAQGPGKHLXDXGKLALQYSPKPMXSSQLLTQVRPRDPTWTKGNARSPEGASRTFPHAEARTRGWRPSS

SEQ ID NO: 1081 - protein, 235 aa, Homo sapiens
  misc_feature (212)..(212): Xaa can be any naturally occurring amino acid
  misc_feature (218)..(218): Xaa can be any naturally occurring amino acid
  misc_feature (224)..(224): Xaa can be any naturally occurring amino acid
  misc_feature (232)..(232): Xaa can be any naturally occurring amino acid
ALDCNSEENNFLTRENGEPDAFDELFDADGDGESYTEEADDGETGETRDEKENLATLFGDMEDLTDEEEVPASQSTENRVLPAPAPRREKTNEELQEELRNLQEQMKALQEQLKVTTIKQTASPARLQKSPVEKSPRPPLKERRVQRIQESTCFSAELDVPALPRTKRVARTPKASPPDPKSSSSRMTSAPSQPLQTISRNKPSGILEVKLXGTPRKXLGKRLXPICVETFXWSW

SEQ ID NO: 1082 - protein, 72 aa, Homo sapiens
VENQVIIVFSKLSVDDCITSFTEVFAQKLEGKQRAMFLYLLVIECSLLYHNKILVFIRTPRGKRIWLNSHSR

SEQ ID NO: 1083 - protein, 52 aa, Homo sapiens
  misc_feature (10)..(11): Xaa can be any naturally occurring amino acid
  misc_feature (14)..(14): Xaa can be any naturally occurring amino acid
  misc_feature (16)..(16): Xaa can be any naturally occurring amino acid
  misc_feature (23)..(23): Xaa can be any naturally occurring amino acid
  misc_feature (33)..(33): Xaa can be any naturally occurring amino acid
  misc_feature (41)..(41): Xaa can be any naturally occurring amino acid
  misc_feature (46)..(46): Xaa can be any naturally occurring amino acid
  misc_feature (48)..(48): Xaa can be any naturally occurring amino acid
GTKNSPETKXXARXLXALPTKMXNGDGNVKGKXLGPKDRRXKFWFXKXRRPC

SEQ ID NO: 1084 - protein, 242 aa, Homo sapiens
  misc_feature (218)..(218): Xaa can be any naturally occurring amino acid
  misc_feature (220)..(220): Xaa can be any naturally occurring amino acid
  misc_feature (225)..(225): Xaa can be any naturally occurring amino acid
QRERARPSGARRMYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAATGRXRXPRAGXDAPQPGDPVPLARAPTR

SEQ ID NO: 1085 - protein, 107 aa, Homo sapiens
  misc_feature (63)..(63): Xaa can be any naturally occurring amino acid
  misc_feature (65)..(66): Xaa can be any naturally occurring amino acid
  misc_feature (89)..(89): Xaa can be any naturally occurring amino acid
  misc_feature (94)..(94): Xaa can be any naturally occurring amino acid
  misc_feature (96)..(97): Xaa can be any naturally occurring amino acid
  misc_feature (103)..(103): Xaa can be any naturally occurring amino acid
QRERARPSGARRMYDNMSTMVYIKEDKLEKLTQDEIISKTKQVIQGLEALKNEHNYILQSLLXTXXCLKKDDESNFGGGEIKHDRKSLXMFGAXLXXAQVMMXFSNY

SEQ ID NO: 1086 - protein, 159 aa, Homo sapiens
  misc_feature (141)..(141): Xaa can be any naturally occurring amino acid
QRERARPSGARRMYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLPDELAHTHXNCRKMTICGLTGGGEKTS

SEQ ID NO: 1087 - protein, 132 aa, Homo sapiens
QRERARPSGARRMYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRPSVPGESMA

SEQ ID NO: 1088 - protein, 198 aa, Homo sapiens
  misc_feature (174)..(174): Xaa can be any naturally occurring amino acid
  misc_feature (176)..(176): Xaa can be any naturally occurring amino acid
  misc_feature (181)..(181): Xaa can be any naturally occurring amino acid
QGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAATGRXRXPRAGXDAPQPGDPVPLARAPTR

SEQ ID NO: 1089 - protein, 96 aa, Homo sapiens
QRERARPSGARRMYDNMSTMVYIKEDKLEKLTQDEIISKTKQVIQGLEALKNEHNSILQSLLETLKCLKKDDESNLVEEKSNMIPEVTGDVGARPE

SEQ ID NO: 1090 - protein, 646 aa, Homo sapiens
  misc_feature (173)..(173): Xaa can be any naturally occurring amino acid
  misc_feature (180)..(180): Xaa can be any naturally occurring amino acid
SPRRETGKESRKSQSPSPKNESARGRKKSRSQSPKKDIARERRQSQSRSPKRDTTRESRRSESLSPRRETSRENKRSQPRVKDSSPGEKSRSQSRERESDRDGQRRERERRTRKWSRSRSHSRSPSRCRTKSKSSSFGRIDRDSYSPRWKGRWANDGWRCPPGNDRYRKNDPXKPNENTXKEKNDIHLDADDPNSADKHRNDCPNWITEKINSGPDPRTRNPEKLKESHWEENRNENSGNSWNKNFGSGWVSNRGRGRGNRGRGTYRSSFAYKDQNENRWQNRKPLSGNSNSSGSESFKFVEQQSYKRKSEQEFSFDTPADRSGWTSASSWAVRKTLPADVQNYYSRRGRNSSGPQSGWMKQEEETSGQDSSLKDQTNQQVDGSQLPINMMQPQMNVMQQQMNAQHQPMNIFPYPVGVHAPLMNIQRNPFNIHPQLPLHLHTGVPLMQVATPTSVSQGLPPPPPPPPPSQQVNYIASQPDGKQLQGIPSSSHVSNNMSTPVLPAPTAAPGNTGMVQGPSSGNTSSSSHSKASNAAVKLAESKVSVAVEASADSSKTDKKLQIQEKAAQEVKLAIKPFYQNKDITKEEYKEIVRKAVDKVCHSKSGEVNSTKVANLVKAYVDKYKYSRKGSQKKTLEEPVSTEKNIG

SEQ ID NO: 1091 - protein, 155 aa, Homo sapiens
RTRNPEKLKESHWEENRNENSGNSWNKNFGSGWVSNRGRGRGNRGRGTYRSSFAYKDQNENRWQNRKPLSGNSNSSGSESFKFVEQQSYKRKSEQEFSFDTPADRSGWTSASSWAVRKTLPADVQNYYSRRGRNSSGPQSGWMKQEEETSGRILA

SEQ ID NO: 1092 - protein, 124 aa, Homo sapiens
VKSVCHSKASNAAVKLAESKVSVAVEASADSSKTDKKLQIQEKAAQEVKLAIKPFYQNKDITKEEYKEIVRKAVDKVCHSKSGEVNSTKVANLVKAYVDKYKYSRKGSQKKTLEEPVSTEKNIG

SEQ ID NO: 1093 - protein, 199 aa, Homo sapiens
  misc_feature (173)..(173): Xaa can be any naturally occurring amino acid
  misc_feature (180)..(180): Xaa can be any naturally occurring amino acid
SPRRETGKESRKSQSPSPKNESARGRKKSRSQSPKKDIARERRQSQSRSPKRDTTRESRRSESLSPRRETSRENKRSQPRVKDSSPGEKSRSQSRERESDRDGQRRERERRTRKWSRSRSHSRSPSRCRTKSKSSSFGRIDRDSYSPRWKGRWANDGWRCPPGNDRYRKNDPXKPNENTXKEKNDIHLDADDPNSCGKH

SEQ ID NO: 1094 - protein, 225 aa, Homo sapiens
NDIHLDADDPNSADKHRNDCPNWITEKINSGPDPRTRNPEKLKESHWEENRNENSGNSWNKNFGSGWVSNRGRGRGNRGRGTYRSSFAYKDQNENRWQNRKPLSGNSNSSGSESFKFVEQQSYKRKSEQEFSFDTPADRSGWTSASSWAVRKTLPADVQNYYSRRGRNSSGPQSGWMKQEEETSGQDSSLKDQTNQQVDGSQLPINMMQPANECNAAQMNAHTSL

SEQ ID NO: 1095 - protein, 246 aa, Homo sapiens
  misc_feature (237)..(237): Xaa can be any naturally occurring amino acid
  misc_feature (242)..(242): Xaa can be any naturally occurring amino acid
TLGLKTSGQDSSLKDQTNQQVDGSQLPINMMQPQMNVMQQQMNAQHQPMNIFPYPVGVHAPLMNIQRNPFNIHPQLPLHLHTGVPLMQVATPTSVSQGLPPPPPPPPPSQQVNYIASQPDGKQLQGIPSSSHVSNNMSTPVLPAPTAAPGNTGMVQGPSSGNTSSSSHSKASNAAVKLAESKVSVAVEASADSSKTDKKLQIQEKAAQEVKLAIKPFYQNKDITKEEYKEIVRKAVXKVGIXRVEK

SEQ ID NO: 1096 - protein, 214 aa, Homo sapiens
  misc_feature (207)..(207): Xaa can be any naturally occurring amino acid
KKVFLPTSLCISYGQWMEEKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKXTALFGCR

SEQ ID NO: 1097 - protein, 214 aa, Homo sapiens; identical to SEQ ID NO: 1096
  misc_feature (207)..(207): Xaa can be any naturally occurring amino acid

SEQ ID NO: 1098 - protein, 178 aa, Homo sapiens
  misc_feature (10)..(10): Xaa can be any naturally occurring amino acid
  misc_feature (13)..(13): Xaa can be any naturally occurring amino acid
  misc_feature (24)..(24): Xaa can be any naturally occurring amino acid
  misc_feature (26)..(26): Xaa can be any naturally occurring amino acid
  misc_feature (38)..(38): Xaa can be any naturally occurring amino acid
  misc_feature (53)..(53): Xaa can be any naturally occurring amino acid
  misc_feature (87)..(87): Xaa can be any naturally occurring amino acid
MMGLLGQSLXQIXQSIHFMREWAXSXAPVTPVPVVESXQLNGGGDVAMLELTXQNFTPNLRVWFGDVEAETMYRCGESMLCVVPDIXAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 1099 - protein, 218 aa, Homo sapiens
TVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVPRWLHPLWTNSQTCVLSYWHGLPKIDN

SEQ ID NO: 1100 - protein, 201 aa, Homo sapiens
  misc_feature (180)..(180): Xaa can be any naturally occurring amino acid
VVQAGVFGRAWEHKSLFHHVSRTSHSGPGLVAKMVKPKYKGRSTINPSKASTNPDRVQGAGGQNMRDRATIRRLNMYRQKERRNSRGKIIKPLQYQSTVASGTVARVEPNIKWFGNTRVIKQSSLQKFQEEMDTVMKDPYKVVMKQSKLPMSLLHDRIRPHNLKGHILDTESFETTFGPXSQKETDQTYFASDMQSLIENA

SEQ ID NO: 1101 - protein, 210 aa, Homo sapiens
  misc_feature (3)..(3): Xaa can be any naturally occurring amino acid
AGXFGRAWEHKSLFHHVSRTSHSGPGLVAKMVKPKYKGRSTINPSKASTNPDRVQGAGGQNMRDRATIRRLNMYRQKERRNSRGKIIKPLQYQSTVASGTVARVEPNIKWFGNTRVIKQSSLQKFQEEMDTVMKDPYKVVMKQSKLPMSLLHDRIRPHNLKVHILDTESFETTFGPKSQRKRPNLFASDMQSLIENAEMSTESYDPGQGS

SEQ ID NO: 1102 - protein, 232 aa, Homo sapiens
  misc_feature (11)..(11): Xaa can be any naturally occurring amino acid
  misc_feature (15)..(16): Xaa can be any naturally occurring amino acid
  misc_feature (22)..(22): Xaa can be any naturally occurring amino acid
  misc_feature (31)..(31): Xaa can be any naturally occurring amino acid
  misc_feature (38)..(39): Xaa can be any naturally occurring amino acid
  misc_feature (49)..(49): Xaa can be any naturally occurring amino acid
  misc_feature (51)..(51): Xaa can be any naturally occurring amino acid
  misc_feature (152)..(152): Xaa can be any naturally occurring amino acid
RVQIPSFKEDXRGPXXVRLPQXCGRFFHESXDFGKIQXXPQFFGNDLVXVXVSDLEKELESFFLMKRRRNRSTKEMMREESSSEPEEENVGNDTKAVIKALDEKIVKYQKFLDKAKAKKFSAVRISKGLSEKIFAKPEEQRKTLEEDVDDRXPSKKGKKRKAQREEEQEHSNKAPRALTSKERRRAVRQQRPKKVGVRYYETHNVKNRNRNKKKTNDSEGQKHKRKKFRQKQ

SEQ ID NO: 1103 - protein, 210 aa, Homo sapiens
  misc_feature (195)..(195): Xaa can be any naturally occurring amino acid
WATKRWVAVLSQDYPTLAFHASLTNPFGKGAFIQLLRQFGKLHTDKKQISVGFIGYPNVGKSSVINTLRSKKVCNVAPIAGETKVWQYITLMRRIFLIDCPGVVYPSEDSETDIVLKGVVQVEKIKSPEDHIGAVLERAKPEYISKTYKIDSWENAEDFLEKLAFRTGKLLKGGEPDLQTVGKMVLNDWQKGRIXFFVKPPNAEPLWAPT

SEQ ID NO: 1104 - protein, 210 aa, Homo sapiens
  misc_feature (182)..(182): Xaa can be any naturally occurring amino acid
VQAGVFGRAWEHKSLFHHVSRTSHSGPGLVAKMVKPKYKGRSTINPSKASTNPDRVQGAGGQNMRDRATIRRLNMYRQKERRNSRGKIIKPLQYQSTVASGTVARVEPNIKWFGNTRVIKQSSLQKFQEEMDTVMKDPYKVVMKQSKLPMSLLHDRIRPHNLKVHILDTESFETTFGPKSRXNDQTYLQVICSLLSKMLKCPLRAMTRAR

SEQ ID NO: 1105 - protein, 368 aa, Homo sapiens
EIDQVVPAAQSSPINCEKRENLLPFVGLNNLGNTCYLNSILQVLYFCPGFKSGVKHLFNIISRKKEALKDEANQKDKGNCKEDSLASYELICSLQSLIISVEQLQASFLLNPEKYTDELATQPRRLLNTLRELNPMYEGYLQHDAQEVLQCILGNIQETCQLLKKEEVKNVAELPTKVEEIPHPKEEMNGINSIEMDSMRHSEDFKEKLPKGNGKRKSDTEFGNMKKKVKLSKEHQSLEENQRQTRSKRKATSDTLESPPKIIPKYISENESPRPSQKKSRVKINWLKSATKQPSILSKFCSLGKITTNQGVKGQSKENECDPEEDLGKCESDNTTNGCGLESPGNTVTPVNVNEVKPINKGEEQIGF

SEQ ID NO: 1106 - protein, 218 aa, Homo sapiens
  misc_feature (178)..(178): Xaa can be any naturally occurring amino acid
  misc_feature (193)..(193): Xaa can be any naturally occurring amino acid
  misc_feature (196)..(196): Xaa can be any naturally occurring amino acid
  misc_feature (198)..(198): Xaa can be any naturally occurring amino acid
  misc_feature (201)..(201): Xaa can be any naturally occurring amino acid
EIDQVVPAAQSSPINCEKRENLLPFVGLNNLGNTCYLNSILQVLYFCPGFKSGVKHLFNIISRKKEALKDEANQKDKGNCKEDSLASYELICSLQSLIISVEQLQASFLLNPEKYTDELATQPRRLLNTLRELNPMYEGYLQHDAQEVLQCILGNIQETCQLLKKEEVKNVAEFLLRXKKSSSEEEMNGLQHXDGXMXLLXTFKRTPKGMGKEKVPWI

SEQ ID NO: 1107 - protein, 121 aa, Homo sapiens
LNYPKRRHLNTWIYTSLLCLLFKIKCSYLYSPYFGVIIYMMFIVPVVFHPRSRISFSTFSFIRVMKLNPWAMSEAQSLECVYSQWCMYILCLDSLRSVSENLDSSLLHKNFICIYEDDSVP

SEQ ID NO: 1108 - protein, 211 aa, Homo sapiens
ETCQLLKKEEVKNVAELPTKVEEIPHPKEEMNGINSIEMDSMRHSEDFKEKLPKGNGKRKSDTEFGNMKKKVKLSKEHQSLEENQRQTRSKRKATSDTLESPPKIIPKYISENESPRPSQKKSRVKINWLKSATKQPSILSKFCSLGKITTNQGVKGQSKENECDPEEDLGKCESDNTTNGCGLESPGNTVTPVNVNEVKPINKGEEQIGF

SEQ ID NO: 1109 - protein, 187 aa, Homo sapiens
NVAELPTKVEEIPHPKEEMNGINSIEMDSMRHSEDFKEKLPKGNGKRKSDTEFGNMKKKVKLSKEHQSLEENQRQTRSKRKATSDTLESPPKIIPKYISENESPRPSQKKSRVKINWLKSATKQPSILSKFCSLGKITTNQGVKGQSKENECDPEEDLGKCESDNTTNGCGLESPGNTVTPVNVNES

SEQ ID NO: 1110 - protein, 314 aa, Homo sapiens
  misc_feature (313)..(313): Xaa can be any naturally occurring amino acid
IPTEVAIESTPMILESSIMSSHVMKGINLSSGDQNLAPEIGIQEIALHSGEEPHAEEHLKGDFYESEHGINIDLNINNHLIAKEMEHNTVCAAGTSPVGEIGEEKILPTSETKQCTVLDTYPGVSEADAGETLSSTGPFALEPDATGTSKGIEFTTASTLSLVNKYDVDLSLTTQDTEHDMVISTSPSGGSEADIEGPLPAKDIHLDLPSNNNLVSKDTEEPLPVKESDQTLAALLSPKESSGGEKEVPPPPKETLPDSGFSANIEDINEADLVRPLLPKDMERLTSLKSWHLKDLYLQVMFGPWTRSAGQPXL

SEQ ID NO: 1111 - protein, 218 aa, Homo sapiens
  misc_feature (217)..(217): Xaa can be any naturally occurring amino acid
PVGEIGEEKILPTSETKQCTVLDTYPGVSEADAGETLSSTGPFALEPDATGTSKGIEFTTASTLSLVNKYDVDLSLTTQDTEHDMVISTSPSGGSEADIEGPLPAKDIHLDLPSNNNLVSKDTEEPLPVKESDQTLAALLSPKESSGGEKEVPPPPKETLPDSGFSANIEDINEADLVRPLLPKDMERLTSLKSWHLKDLYLQVMFGPWTRSAGQPXL

SEQ ID NO: 1112 - protein, 163 aa, Homo sapiens
IPTEVAIESTPMILESSIMSSHVMKGINLSSGDQNLAPEIGIQEIALHSGEEPHAEEHLKGDFYESEHGINIDLNINNHLIAKEMEHNTVCAAGTSPVGEIGEEKILPTSETKQRTVLDTYPGVSEADAGETLSSTGPFALEPDATGTSKGIEFTTASTLSLS

SEQ ID NO: 1113 - protein, 332 aa, Homo sapiens
  misc_feature (172)..(172): Xaa can be any naturally occurring amino acid
  misc_feature (190)..(190): Xaa can be any naturally occurring amino acid
  misc_feature (193)..(193): Xaa can be any naturally occurring amino acid
  misc_feature (195)..(195): Xaa can be any naturally occurring amino acid
  misc_feature (199)..(199): Xaa can be any naturally occurring amino acid
  misc_feature (205)..(205): Xaa can be any naturally occurring amino acid
  misc_feature (207)..(207): Xaa can be any naturally occurring amino acid
SGCGAPAAGAGPRGAELGSGAQAVPRGAMKGKEEKEGGARLGAGGGSPEKSPSAQELKEQGNRLFVGRKYPEAAACYGRAITRNPLVAVYYTNRALCYLKMQQHEQALADCRRALELDGQSVKAHFFLGQCQLEMESYDEAIANLQRAYSLAKEQRLNFGDDIPSALRIAKXKRWNSIEERRIHQESELXFYXFXLIAXDRERKXKXCQGNHEGYEDDKPRPGPSRLALRPSTTSTWRTWTSFFFQVDERGRSETSPTYLCGKISFEPMREPCITPSGITYDRKDIEEHLQRVGHFDPVTRSPLTQEQLIPNLAMKEVIDAFISENGWVEDY

SEQ ID NO: 1114 - protein, 259 aa, Homo sapiens
  misc_feature (234)..(234): Xaa can be any naturally occurring amino acid
VTQEFTQYWAQREADFKETLLQEREILEENAERRLAIFKDLVGKCDTREEAAKDICATKVETEEATACLELKFNQIKAELAKTKGELIKTKEELKKRENESDSLIQELETSNKKIITQNQRIKELINIIDQKEDTINEFQNLKSHMENTFKCNDKADTSSLIINNKLICNETVEVPKDSKSKICSERKRVNENELQQDEPPAKKGSIHCSSASLKTKRKVEEVRPEHCRKLKTXRVLQGKIMKGLESIFSSLFENDLKK

SEQ ID NO: 1115 - protein, 204 aa, Homo sapiens
  misc_feature (7)..(7): Xaa can be any naturally occurring amino acid
  misc_feature (15)..(15): Xaa can be any naturally occurring amino acid
RISNSRXPIGKILSXLVLKPIWEECKEIVKASSKKSHQIEELEQQIEKLQAEVKGYKDENNRLKEKEHKNQDDLLKEKETLIQQLKEELQEKNVTLDVQIQHVVEGKRALSELTQGVTCYKAKIKELETILETQKVECSHSAKLEQDILEKESIILKLERNLKEFQEHLQDSVKNTKDLNVKELKLKEEITQLTNNLQDMKHLL

SEQ ID NO: 1116 - protein, 92 aa, Homo sapiens
  misc_feature (17)..(17): Xaa can be any naturally occurring amino acid
VQLSQEKRYTYDKLGKXQRRNEELEEQCVQHGRVHETMKQRLRQLDKHSQATAQQLVQLLSKQNQLLLERQSLSEEVDRLRTQLPSMPQSDC

SEQ ID NO: 1117 - protein, 224 aa, Homo sapiens
  misc_feature (156)..(156): Xaa can be any naturally occurring amino acid
  misc_feature (169)..(169): Xaa can be any naturally occurring amino acid
  misc_feature (176)..(177): Xaa can be any naturally occurring amino acid
  misc_feature (190)..(191): Xaa can be any naturally occurring amino acid
  misc_feature (201)..(201): Xaa can be any naturally occurring amino acid
  misc_feature (211)..(211): Xaa can be any naturally occurring amino acid
  misc_feature (214)..(215): Xaa can be any naturally occurring amino acid
  misc_feature (217)..(217): Xaa can be any naturally occurring amino acid
  misc_feature (220)..(220): Xaa can be any naturally occurring amino acid
  misc_feature (222)..(222): Xaa can be any naturally occurring amino acid
GNSSLNSTSNTKVSAVPTNMAAKKTSTPKINFVGGNKLQSTGNKAEDTKGTECVKSTPVTSAVQIPEVKQDTVSEPVTPASLAALQSDVQPVGHDYVEEVRNDEGKVIRFHCKLCECSFNDPNAKEMHLKGRRHRLQYKKKVNPDLQVEVKPSIRXRKIQEEKMRKQMXKEEYWRXXKEKGALENGNETXXKRHVLEENGXRTTLFGMIAXNAXXRXSHXPXGH

SEQ ID NO: 1118 - protein, 161 aa, Homo sapiens
ERCGAARFACKCITKRQPRMKKASRSVGSVPKVSAISKTQTAEKIKPENSSSASTGGKLVKPGTAASLSKTKSSDDLLAGMAGGVTVTNGVKGKKSTCPSAAPSASAPAMTTVENKSKISTGTASSTKRSTSTGQGANDMALAKRSRSRTATECDVRMSKS

SEQ ID NO: 1119 - protein, 185 aa, Homo sapiens
  misc_feature (173)..(173): Xaa can be any naturally occurring amino acid
  misc_feature (183)..(183): Xaa can be any naturally occurring amino acid
LIEAEGIEDIEKEDIESQEIEAQEGEDDTFLTAQDGEEEENEKDIAGSGDGTQEVSKPLPSEGSLAEADHTAHEEMEAHTTVKEAEDDNISVTIQAEDAITLDFDGDDLLETGKNVKITDSEASKPKDGQDAIAQSPEKESKDYEMNANHKDGKKEDCVKGDPVEKEARESSXKAESGDQRKXYF

SEQ ID NO: 1120 - protein, 236 aa, Homo sapiens
  misc_feature (10)..(10): Xaa can be any naturally occurring amino acid
  misc_feature (13)..(14): Xaa can be any naturally occurring amino acid
  misc_feature (17)..(17): Xaa can be any naturally occurring amino acid
  misc_feature (28)..(28): Xaa can be any naturally occurring amino acid
  misc_feature (74)..(74): Xaa can be any naturally occurring amino acid
  misc_feature (94)..(94): Xaa can be any naturally occurring amino acid
  misc_feature (98)..(98): Xaa can be any naturally occurring amino acid
  misc_feature (106)..(106): Xaa can be any naturally occurring amino acid
  misc_feature (112)..(112): Xaa can be any naturally occurring amino acid
  misc_feature (171)..(171): Xaa can be any naturally occurring amino acid
  misc_feature (236)..(236): Xaa can be any naturally occurring amino acid
KQVSQKMGRXAIXXSPXKESKDYEMNAXHKDGKKEDCVKGDPVEKEARESSKKAESGDKEKDTLKKGPSSTGAXGQAKSSSKESKDSKTSSKDXKGSXSSTSGSSXSSTKNXWVSGLSSNTKAADLKNLFGKYGKVLSAKVVTNARSPGAKCYGIVTMSSSTEVSRCIAHXHRTELHGQLISVEKVKGDPSKKEMKKENDEKSSSRSSGDKKNTSDRSSKTQASVKKEEKRSSEKX

SEQ ID NO: 1121 - protein, 205 aa, Homo sapiens
  misc_feature (172)..(172): Xaa can be any naturally occurring amino acid
  misc_feature (190)..(190): Xaa can be any naturally occurring amino acid
  misc_feature (193)..(193): Xaa can be any naturally occurring amino acid
  misc_feature (195)..(195): Xaa can be any naturally occurring amino acid
  misc_feature (199)..(199): Xaa can be any naturally occurring amino acid
  misc_feature (202)..(202): Xaa can be any naturally occurring amino acid
SGCGAPAAGAGPRGAELGSGAQAVPRGAMKGKEEKEGGARLGAGGGSPEKSPSAQELKEQGNRLFVGRKYPEAAACYGRAITRNPLVAVYYTNRALCYLKMQQHEQALADCRRALELDGQSVKAHFFLGQCQLEMESYDEAIANLQRAYSLAKEQRLNFGDDIPSALRIAKXKRWNSIEERRIHQESELXFYXFXLIAXDRXKET

SEQ ID NO: 1122 - protein, 136 aa, Homo sapiens
  misc_feature (9)..(9): Xaa can be any naturally occurring amino acid
  misc_feature (11)..(11): Xaa can be any naturally occurring amino acid
FPRKRERKXKXCQGNHEGYEDDKPRPGPSRLALRPSTTSTWRTWTSFFFQVDERGRSETSPTYLCGKISFEPMREPCITPSGITYDRKDIEEHLQRVGHFDPVTRSPLTQEQLIPNLAMKEVIDAFISENGWVEDY

SEQ ID NO: 1123 - protein, 206 aa, Homo sapiens
  misc_feature (202)..(202): Xaa can be any naturally occurring amino acid
NLKGILEESPSEAEDFISGITQTMVEAVAEVEKNETVSEILPSTCIVTLVPGIPTGDEKTVDKKNISEKKGNMDEKEEKEFNTKETRMDLQIGTEKAEKNEGRMDAEKVEKMAAMKEKPAENTLFKAYPNKGVGQANKPDETSKTSILAVSDVSSSKPSIKAVIVSSPKAKATVSKTENQKSFPKSVPRDQINAEKKLSAQXIWSA

SEQ ID NO: 1124 - protein, 94 aa, Homo sapiens
QLNSTQRELELENSAIRKSCCAEPAKGEEAFQMSEVDEESGLKDSEPERKRKKTEDSSSGKSVASDVPEELDFLDLRLDSSVQFVPSSTQVKKQ

SEQ ID NO: 1125 - protein, 237 aa, Homo sapiens
  misc_feature (162)..(162): Xaa can be any naturally occurring amino acid
  misc_feature (170)..(170): Xaa can be any naturally occurring amino acid
  misc_feature (197)..(197): Xaa can be any naturally occurring amino acid
  misc_feature (200)..(200): Xaa can be any naturally occurring amino acid
  misc_feature (211)..(212): Xaa can be any naturally occurring amino acid
  misc_feature (216)..(216): Xaa can be any naturally occurring amino acid
  misc_feature (224)..(225): Xaa can be any naturally occurring amino acid
  misc_feature (227)..(227): Xaa can be any naturally occurring amino acid
  misc_feature (233)..(233): Xaa can be any naturally occurring amino acid
  misc_feature (237)..(237): Xaa can be any naturally occurring amino acid
RPGKRRCGVGCFPEAGLNGSRLSHRVSSPPSPNQEIARERCGAARFACKCITKRQPRMKKASRSVGSVPKVSAISKTQTAEKIKPENSSSASTGGKLVKPGTAASLSKTKSSDDLLAGMAGGVTVTNGVKGKKSTCPSAAPSASAPAMTTVENKSKISTGTXSSTKRSTXTGNKESSSTRERLRERTRLNQSKKLPXAGXGANDMAFGQTXXQLNXFQNVTFRXXQXLSQTIXNPVX

SEQ ID NO: 1126 - protein, 195 aa, Homo sapiens
  misc_feature (182)..(182): Xaa can be any naturally occurring amino acid
LNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRPRELKEHFPEGQKISLVERRNDFPXWLMHPLSRDWSHP

SEQ ID NO: 1127 - protein, 160 aa, Homo sapiens
EEGRALHDGIAIAYATLEYFIRDVKSLTLFVTHYPPVCELEKNYSHQVGNYHMGFLVSEDESKLDPGTAEQVPDFVTFLYQITRGIAARSYGLNVAKLADVPGEILKKAAHKSKELEGLINTKRKRLKYFAKLWTMHNAQDLQKWTEEFNMEETQTSLLH

SEQ ID NO: 1128 - protein, 82 aa, Homo sapiens
  misc_feature (73)..(73): Xaa can be any naturally occurring amino acid
  misc_feature (76)..(76): Xaa can be any naturally occurring amino acid
IPSLQEEAKKQIEDLNMTLEKLRSDLDEKETERSDMKETIFELEDEVEQHRAVKLHDNLIISDLENTGKKLQXPKXDMGKRN

SEQ ID NO: 1129 - protein, 414 aa, Homo sapiens
  misc_feature (361)..(362): Xaa can be any naturally occurring amino acid
  misc_feature (367)..(368): Xaa can be any naturally occurring amino acid
  misc_feature (379)..(379): Xaa can be any naturally occurring amino acid
  misc_feature (384)..(384): Xaa can be any naturally occurring amino acid
  misc_feature (388)..(388): Xaa can be any naturally occurring amino acid
SRTRTSDRLNRIANQVAIQRKKQFVERAHSYWLLKRLSRNGAPLLRRLQSSLQSQRSSQQRENDEEMKAAKEKLKYWQRLRHDLERARLLIELLRKREKLKREQVKVEQVAMELRLTPLTVLLRSVLDQLQDKDPARIFAQPVSLKEVPDYLDHIKHPMDFATMRKRLEAQGYKNLHEFEEDFDLIIDNCMKYNARDTVFYRAAVRLRDQGGVVLRQARREVDSIGLEEASGMHLPERPAAAPRRPFSWEDVDRLLDPANRAHLGLEEQLRELLDMLDLTCAMKSSGSRSKRAKLLKKEIALLRNKLSQQHSQPLPTGPGLEGFEEDGAALGPGGGRRSPSEVGDSSAAKEKVAEHMRRLXXWRRSXXEKRLDAGLHQXLLGCXEPTXNPAGGLGGGRPHPDDLGPSSSRFSFK

SEQ ID NO: 1130 - protein, 178 aa, Homo sapiens
IVERESGHYVEMHARYIGTTVFVRQVGRYLTLAIRMPEDLAMSYEESQDLQLCVNGCPLSERIDDGQGQVSAILGHSLPRTSLVQAWPGYTLETANTQCHEKMPVKDIYFQSCVFDLLTTGDANFTAAAHSALEDVEALHPRKERWHIFPSSGNGTPRGGSDLSVSLGLTCLILIVFL

SEQ ID NO: 1131 - protein, 118 aa, Homo sapiens
AGRRHRTGNRCPSLASSHGIECWQSPVCSQARPAPRRCEAGCVPGWQTPGPARHRCVHSGGSRSRTAAGPGSPRRTWPGLQAYGWQGSGSDPPAAQTLWSLYSGRASPHSGHSPFPRY

SEQ ID NO: 1132 - protein, 166 aa, Homo sapiens
TDRQITASTGSPIATAGENVPAFLPWVQGLHILQGTVGCGSKVGITSGEQVEDTGLEIDVLHWHLLMALSVGSLQCVARPGLHQGGARQAVSQDGRHLALPVIDAFTQGAAVHAQLQVLALLVGHGQVFRHTDGKGQVATHLPHKHCGPYIAGVHLHIVATLPFHD

SEQ ID NO: 1133 - protein, 365 aa, Homo sapiens
SAHSRLAARHYSGPGPAPARPRRRQFRLKKLIDQEIKSQEEKEQEKEKRVTTLKEELTKLKSFALMVVDEQQRLTAQLTLQRQKIQELTTNAKETHTKLALAEARVQEEEQKATRLEKELQTQTTKFHQDQDTIMAKLTNEDSQNRQLQQKLAALSRQIDELEETNRSLRKAEEELQDIKEKISKGEYGNAGIMAEVEELRKRVLDMEGKDEELIKMEEQCRDLNKRLERETLQSKDFKLEVEKLSKRIMALEKLEDAFNKSKQECYSLKCNLEKERMTTKQLSQELESLKVRIKELEAIESRLEKTEFTLKEDLTKLKTLTVMFVDERKTMSEKLKKTEDKLQAASSQLQVEQNKVTTVTEKVN

SEQ ID NO: 1134 - protein, 221 aa, Homo sapiens
SGKMAKVSELYDVTWEEMRDKMRKWREENSRNSEQIVEVGEELINEYASKLGDDIWIIYEQVMIAALDYGRDDLALFCLQELRRQFPGSHRVKRLTGMRFEAMERYDDAIQLYDRILQEDPTNTAARKRKIAIRKAQGKNVEAIRELNEYLEQFVGDQEAWHELAELYINEHDYAKAAFCLEELMMTNPHNHLYCQQYAEVKYTQGGLETLELSRKFLHRH

SEQ ID NO: 1135 - protein, 118 aa, Homo sapiens
RELEPAEFETMLLFCPGCGNGLIVEEGQRCHRFACNTCPYVHNITRKVTNRKYPKLKEVDDVLGGAAAWENVDSTAESCPKCEHPRAYFMQLQTRSADEPMTTFYKCCNAQCGHRWRD

SEQ ID NO: 1136 - protein, 126 aa, Homo sapiens
GSWAILALIPPAVSTLSIAALVEGGHRLICRAGLKLHEVSTRMFAFGTRLCSRVNILPGSCSTKHIIHFFQFWVLPICYLAGDVVHVGARVAGEAVAALSLLHDQPVPAAGAEQQHGLELRRLQLP

SEQ ID NO: 1137 - protein, 208 aa, Homo sapiens
SLRFYLSLGQLYLSMNIDDKLEGLFLKCGGIDEMQSSRTMVVMGGVSGQSTVSGELQDSVLQDRSMPHQEILAADEVLQESEMRQQDMISHDELMVHEETVKNDEEQMETHERLPQGLQYALNVPISVKQEITFTDVSEQLMRDKKQIREPVDLQKKKKRKQRSPAKILTINEDGSLGLKTPKSHVCEHCNAAFRTNYPYRDMSSSYR

SEQ ID NO: 1138 - protein, 121 aa, Homo sapiens
  misc_feature (54)..(54): Xaa can be any naturally occurring amino acid
  misc_feature (62)..(62): Xaa can be any naturally occurring amino acid
  misc_feature (79)..(79): Xaa can be any naturally occurring amino acid
  misc_feature (88)..(88): Xaa can be any naturally occurring amino acid
  misc_feature (114)..(114): Xaa can be any naturally occurring amino acid
KRRLQGKECCRVEKEIMVEFLPFIGFRNPQYHLNHLCHPIPPLNTLGKRPSRQXTCLNFQAXDSSLYPRAGAESRGHRXQAAAAPTFXGALRGGEGGRGENFCCGSFGNSSHPXAFLLFLP

SEQ ID NO: 1139 - protein, 178 aa, Homo sapiens
RSKGCDCCGEKSQPQEKSLIGLKNTENNDVEISETKKADVQAPVSPSETSQANPYSEGQFLDEHHSVNFHLGLKEDNDTINDSLIVSETKSKENTMQESLPSGIVNFREEICDMDSSEAMSLESQESPNENFKTVGPCLGDSKNVSQESLETKEEKPEETPKMELSLENVLLKEMHVK

SEQ ID NO: 1140 - protein, 187 aa, Homo sapiens
  misc_feature (157)..(157): Xaa can be any naturally occurring amino acid
  misc_feature (164)..(164): Xaa can be any naturally occurring amino acid
FLNLRGDIGSHWLQFKLLTEISSAVFILTDNISKKEYKLLYSMKESTTKYYFILSPYRGKRNTNLRFLNKLIPVLKIDHSHVLVKVSSTDSDSFVKRIRAIVGNVLRAPCRRVSVEDMAHAARKLGLKVDEDCEECQKAKDRMERITRKIKDSDAYXKDQLRLXGDPWRKAAQVEKEFCNFSGPWPP

SEQ ID NO: 1141 - protein, 145 aa, Homo sapiens
  misc_feature (3)..(3): Xaa can be any naturally occurring amino acid
  misc_feature (14)..(14): Xaa can be any naturally occurring amino acid
  misc_feature (18)..(18): Xaa can be any naturally occurring amino acid
  misc_feature (20)..(21): Xaa can be any naturally occurring amino acid
  misc_feature (27)..(27): Xaa can be any naturally occurring amino acid
  misc_feature (31)..(31): Xaa can be any naturally occurring amino acid
  misc_feature (43)..(43): Xaa can be any naturally occurring amino acid
  misc_feature (49)..(49): Xaa can be any naturally occurring amino acid
  misc_feature (55)..(55): Xaa can be any naturally occurring amino acid
  misc_feature (57)..(57): Xaa can be any naturally occurring amino acid
  misc_feature (70)..(70): Xaa can be any naturally occurring amino acid
  misc_feature (73)..(73): Xaa can be any naturally occurring amino acid
  misc_feature (98)..(98): Xaa can be any naturally occurring amino acid
KWXVPIRHEKPSKXQRFXSXXQQVLKXESDXTDQFKRCYQEYXSPQGRXTSSSLXCXSSCQGSCGVGPLXSCXLSLAPGVGAASLVTAGPGGQVVPGXRWGSCPEEAEVGLAPAQPKGLQWTSIQDVSARGVQGTPMAPYLLTDL

SEQ ID NO: 1142 - protein, 67 aa, Homo sapiens
  misc_feature (1)..(1): Xaa can be any naturally occurring amino acid
  misc_feature (4)..(4): Xaa can be any naturally occurring amino acid
  misc_feature (10)..(11): Xaa can be any naturally occurring amino acid
  misc_feature (13)..(14): Xaa can be any naturally occurring amino acid
  misc_feature (17)..(17): Xaa can be any naturally occurring amino acid
  misc_feature (29)..(29): Xaa can be any naturally occurring amino acid
  misc_feature (33)..(33): Xaa can be any naturally occurring amino acid
  misc_feature (47)..(47): Xaa can be any naturally occurring amino acid
  misc_feature (51)..(52): Xaa can be any naturally occurring amino acid
  misc_feature (58)..(58): Xaa can be any naturally occurring amino acid
  misc_feature (65)..(65): Xaa can be any naturally occurring amino acid
XHFXFLTLVXXNXXTFXFCSASHVEWAPXIFKXPKHKPHMGAPFKKXVGHXXTFLNLXTGVFLDXLK

SEQ ID NO: 1143 - protein, 149 aa, Homo sapiens
ENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACTRSVVLSVETPIA

SEQ ID NO: 1144 - protein, 126 aa, Homo sapiens
  misc_feature (71)..(71): Xaa can be any naturally occurring amino acid
  misc_feature (78)..(78): Xaa can be any naturally occurring amino acid
  misc_feature (86)..(86): Xaa can be any naturally occurring amino acid
  misc_feature (94)..(94): Xaa can be any naturally occurring amino acid
  misc_feature (109)..(109): Xaa can be any naturally occurring amino acid
  misc_feature (113)..(113): Xaa can be any naturally occurring amino acid
  misc_feature (119)..(119): Xaa can be any naturally occurring amino acid
HPRPARCPLVTPTPTELERLRLRSRPVYGVCPVYEDVPARNERIYVYENKKEAFASCQDDQRVRFKAFSPXKTLKNLXKEFVNISXSNKTSLHXFCENNFTLFNDKLKXVGLXNKTAPXASDSSKI

SEQ ID NO: 1145 - protein, 152 aa, Homo sapiens
RPAAPASGEMTMDALLARLKLLNPDDLREEIVKAGLKCGPITSTTRFIFEKKLAQALLEQGGRLSSFYHHEAGVTALSQDPQRILKPAEGNPTDQAGFSEDRDFGYSVGLNPPEEEAVTSKTCSVPPSDTDTYRAGATASKEPPCLWGVSSV

SEQ ID NO: 1146 - protein, 176 aa, Homo sapiens
PRGAFMQLITVAEGFSQDLGCDHILVIDSGGLIGGALTSAGDRFELEASLATLLMGLSNVTVISLAETKDIPAAILHAFLRLEKTGHMPNYQFVYQNLHDVSVPGPRPRDKRQLLDPPGDLSRAAAQMEKQGDGFRALAGLAFCDPENNTSGTSSLWHGHLHGRSELWPTVKPYLN

SEQ ID NO: 1147 - protein, 113 aa, Homo sapiens
  misc_feature (8)..(9): Xaa can be any naturally occurring amino acid
MFLFWFDXXFLMFSSRISSIQIWFHCRPKLTAAMEVSVPQAGCARCVVLRVAEGQACQCPEAVALFLHLGCSPAQVTRWIQELSLVSGPRAGNRYIMKVLVYKLVVGHVPRFF

SEQ ID NO: 1148 - protein, 136 aa, Homo sapiens
  misc_feature (18)..(19): Xaa can be any naturally occurring amino acid
  misc_feature (34)..(34): Xaa can be any naturally occurring amino acid
  misc_feature (46)..(46): Xaa can be any naturally occurring amino acid
  misc_feature (48)..(48): Xaa can be any naturally occurring amino acid
  misc_feature (65)..(65): Xaa can be any naturally occurring amino acid
  misc_feature (89)..(89): Xaa can be any naturally occurring amino acid
  misc_feature (96)..(96): Xaa can be any naturally occurring amino acid
  misc_feature (99)..(99): Xaa can be any naturally occurring amino acid
  misc_feature (129)..(129): Xaa can be any naturally occurring amino acid
EDEQKTEGLESPQTVFKXXSDLTDQLQRCYQEYXSPQGRETSSSLXCXSSCQGSCGVGPLYSCSXSLAPGVGAASLVTAGPGGQVVPGXRWGSCPXEAXVGLAPAQPKGLQWTSIQDVSARGVQGTPMXPYLLTDL

SEQ ID NO: 1149 - protein, 109 aa, Homo sapiens
  misc_feature (6)..(6): Xaa can be any naturally occurring amino acid
  misc_feature (13)..(13): Xaa can be any naturally occurring amino acid
  misc_feature (20)..(20): Xaa can be any naturally occurring amino acid
  misc_feature (22)..(22): Xaa can be any naturally occurring amino acid
  misc_feature (24)..(24): Xaa can be any naturally occurring amino acid
  misc_feature (52)..(53): Xaa can be any naturally occurring amino acid
  misc_feature (68)..(68): Xaa can be any naturally occurring amino acid
  misc_feature (80)..(81): Xaa can be any naturally occurring amino acid
  misc_feature (98)..(98): Xaa can be any naturally occurring amino acid
EGFLWXTPFLMGXPNGGVVXLXPXKRAGAPIRHEKTSKRQRVWSLLKQCLKXXVTSQTSFRDVTKNIXAPRVGRQAAVCXXSAPVKDPAGWALCIAAXCHWPLEWEQRP

SEQ ID NO: 1150 - protein, 88 aa, Homo sapiens
  misc_feature (4)..(4): Xaa can be any naturally occurring amino acid
  misc_feature (11)..(11): Xaa can be any naturally occurring amino acid
  misc_feature (15)..(15): Xaa can be any naturally occurring amino acid
  misc_feature (20)..(20): Xaa can be any naturally occurring amino acid
  misc_feature (37)..(37): Xaa can be any naturally occurring amino acid
  misc_feature (68)..(68): Xaa can be any naturally occurring amino acid
  misc_feature (71)..(71): Xaa can be any naturally occurring amino acid
  misc_feature (77)..(77): Xaa can be any naturally occurring amino acid
SVWXRYNKVLXGTTXRPVNXSWAGVREAFTDQSINTXPWECLAHHGHSHLECWSTGGPWVGREQGLLXLPXDNFPTXVLGPPARLGLQ

SEQ ID NO: 1151 - protein, 111 aa, Homo sapiens
  misc_feature (3)..(3): Xaa can be any naturally occurring amino acid
  misc_feature (7)..(7): Xaa can be any naturally occurring amino acid
  misc_feature (11)..(11): Xaa can be any naturally occurring amino acid
  misc_feature (15)..(16): Xaa can be any naturally occurring amino acid
  misc_feature (18)..(18): Xaa can be any naturally occurring amino acid
  misc_feature (26)..(26): Xaa can be any naturally occurring amino acid
  misc_feature (29)..(29): Xaa can be any naturally occurring amino acid
  misc_feature (39)..(39): Xaa can be any naturally occurring amino acid
GQXQCSXCNKXFPPXXVXSTCTCASXGKXSPYECYIAKXKFSHKTFLERHVALHSASNGTPPAGTPPGARAGPPGVVACTEGTTYVCSVCPAKFDQIEQFNDHMRMHVSDG

SEQ ID NO: 1152 - protein, 176 aa, Homo sapiens
  misc_feature (170)..(170): Xaa can be any naturally occurring amino acid
QSGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMXYLFDKK

SEQ ID NO: 1153 - protein, 217 aa, Homo sapiens
  misc_feature (207)..(207): Xaa can be any naturally occurring amino acid
  misc_feature (216)..(216): Xaa can be any naturally occurring amino acid
EIVEPELSIEVCEEKASAVLPPTCIQLLDSSNWKERLACMEEFQKAVELMDRTEMPCQALVRMLAKKPGWKETNFQVMQMKLHIVALIAQKGNFSKTSAQVVLDGLVDKIGDVKCGNNAKEAMTAIAEACMLPWTAEQVVSMAFSQKNPKNQSETLNWLSNAIKEFGFSGLNVKAFINNVKTALAATNPAVRTAAITLLGVMYLYVXPSFAKWSFXG

SEQ ID NO: 1154 - protein, 261 aa, Homo sapiens
  misc_feature (10)..(10): Xaa can be any naturally occurring amino acid
GLKVLKGILXPHGDESIEQLKTQMSSCVAKWLQDEMFHSDFQHHNKALAVMVDHLESEKEGVIGCLDLILKWLTLRFFDTNTSVLMKALEYLKLLFTLLSEEEYHLTENEASSFIPYLVVKVGEPKDVIRKDVRAILNRMCLVYPASKMFPFIMEGTKSKNSKQRAECLEELGCLVESYGMNVCQPTPGKALKEIAVHIGDRDNAVRNAALNTIVTVYNVHGDQVFKLIGNLSEKDMSMLESTSRAAAGPSIFHPGGYQVS

SEQ ID NO: 1155 - protein, 174 aa, Homo sapiens
TEPCRTAENCTATMSENNKNSLESSLRQLKCHFTWNLMEGENSLDDFEDKVFYRTEFQNREFKATMCNLLAYLKHLKGQNEAALECLRKAEELIQQEHADQAEIRSLVTWGNYAWVYYHMGRLSDVQIYVDKVKHVCEKFSSPYRIESPELDCEEGWTRLKCGGNQNERAKVCF

SEQ ID NO: 1156 - protein, 211 aa, Homo sapiens
  misc_feature (179)..(179): Xaa can be any naturally occurring amino acid
  misc_feature (181)..(181): Xaa can be any naturally occurring amino acid
  misc_feature (189)..(189): Xaa can be any naturally occurring amino acid
  misc_feature (196)..(196): Xaa can be any naturally occurring amino acid
AAAATTAFGCRIWNPCAALTMKQSSNVPAFLSKLWTLVEETHTNEFITWSQNGQSFLVLDEQRFAKEILPKYFKHNNMASFVRQLNMYGFRKVVHIDSGIVKQERDGPVEFQHPYFKQGQDDLLENIKRKVSSSKPEENKIRQEDLTKIISSAQKVQIKQETIESRLSELKSENESLWXEXSEFQQKHXQQQQVIXKNVSLLVHWFKITQL

SEQ ID NO: 1157 - protein, 231 aa, Homo sapiens
  misc_feature (196)..(196): Xaa can be any naturally occurring amino acid
  misc_feature (207)..(207): Xaa can be any naturally occurring amino acid
  misc_feature (217)..(217): Xaa can be any naturally occurring amino acid
  misc_feature (219)..(219): Xaa can be any naturally occurring amino acid
RQDLYSARDLQGLTVEHAIDSFREGETMILTLKDKGVLQEEEDVLVNVNLVDKERAEKNVELRKKKPDYLPYAEDESVDDLAQQKPRSILSKYDEELEGERPHSFRLEQGGTADGLRERELEEIRAKLRLQAQSLSTVGPRLASEYLTPEEMVTFKKTKRRVKKIRKKEKEVVVRADDLLPLGDQTQDGDFGFKLXGTGSPPKCPKXEEEERTFALXPXRRTTPRSGRTLD

SEQ ID NO: 1158 - protein, 76 aa, Homo sapiens
  misc_feature (32)..(33): Xaa can be any naturally occurring amino acid
  misc_feature (42)..(42): Xaa can be any naturally occurring amino acid
  misc_feature (48)..(49): Xaa can be any naturally occurring amino acid
  misc_feature (53)..(53): Xaa can be any naturally occurring amino acid
  misc_feature (60)..(60): Xaa can be any naturally occurring amino acid
  misc_feature (62)..(62): Xaa can be any naturally occurring amino acid
  misc_feature (66)..(67): Xaa can be any naturally occurring amino acid
  misc_feature (69)..(70): Xaa can be any naturally occurring amino acid
  misc_feature (76)..(76): Xaa can be any naturally occurring amino acid
SLRFYLSLGQLYLSMNIDDKLEGLFLKCGGIXXMQSSRTMVXMGGVSXXLLCXGKLPGFXTXKIEXXPXXEDPCCX

SEQ ID NO: 1159 - protein, 148 aa, Homo sapiens
  misc_feature (4)..(4): Xaa can be any naturally occurring amino acid
  misc_feature (6)..(6): Xaa can be any naturally occurring amino acid
  misc_feature (20)..(20): Xaa can be any naturally occurring amino acid
  misc_feature (52)..(52): Xaa can be any naturally occurring amino acid
  misc_feature (60)..(60): Xaa can be any naturally occurring amino acid
TSRXMXPCPSIAFDPGMNFXLRTTPDKSHFGLIVGDSQHSFPFSGDETNHVXATSTQDFXDQVTSQKKAEAQPVHQAYQMSSFEQPFRAPYHGSRAGIATQFSTANGQVNLRGPGTSAEFSEFPLVNVNDNRAGMTSSPDATTGQTFG

SEQ ID NO: 1160 - protein, 217 aa, Homo sapiens
  misc_feature (166)..(166): Xaa can be any naturally occurring amino acid
  misc_feature (180)..(181): Xaa can be any naturally occurring amino acid
  misc_feature (184)..(184): Xaa can be any naturally occurring amino acid
  misc_feature (190)..(190): Xaa can be any naturally occurring amino acid
  misc_feature (201)..(201): Xaa can be any naturally occurring amino acid
  misc_feature (209)..(209): Xaa can be any naturally occurring amino acid
  misc_feature (212)..(213): Xaa can be any naturally occurring amino acid
SLPASFSPLVPSTSCEGIHLCAELLGTMASLSLAPVNIFKAGADEERAETARLTSFIGAIAIGDLVKSTLGPKGMDKILLSSGRDASLMVTNDGATILKNIGVDNPAAKVLVDMSRVQDDEVGDGTTSVTVLAAELLREAESLIAKKIHPQTIIAGWREATKAARXALLSSAVDHGSHEXXFRXELMNIXGPHYPQNFLLXTKTTLQKXAVXXVLKL

SEQ ID NO: 1161 - protein, 226 aa, Homo sapiens
  misc_feature (7)..(7): Xaa can be any naturally occurring amino acid
  misc_feature (14)..(14): Xaa can be any naturally occurring amino acid
  misc_feature (37)..(37): Xaa can be any naturally occurring amino acid
  misc_feature (49)..(49): Xaa can be any naturally occurring amino acid
  misc_feature (166)..(166): Xaa can be any naturally occurring amino acid
PDQLDPXVARKLLXKKNPSCFPRRRRSRLMTLTEVSXSMKAFISKVSTXKGAELPREPFEAPITFDADSFLNYFDKILGPRPNESDSDDLDDEDFECLDSDDDLDFETHEPGEEASLKGTLDNLKSYMAQMDQELAHTCISKSFTTRNQVEPVSQTTDNNSDEEDXGTGESVMAPVDVDLNLVSNILESYSSQAGLAGPASNLLQSMGVQLPDNTDHRPTSKPTKN

SEQ ID NO: 1162 - protein, 237 aa, Homo sapiens
  misc_feature (205)..(207): Xaa can be any naturally occurring amino acid
  misc_feature (221)..(221): Xaa can be any naturally occurring amino acid
  misc_feature (229)..(229): Xaa can be any naturally occurring amino acid
  misc_feature (232)..(232): Xaa can be any naturally occurring amino acid
EVTRSLLQRWGASFRRGADFDSWGQLVEAIDEYQILARHLQKEAQAQHNNSEFTEEQKKTIGKIATCLELRSAALQSTQSQEEFKLEDLKKLEPILKNILTYNKEFPFDVQPVPLRRILAPGEEENLEFEEDEEEGGAGAGSPDSFPARVPGTLLPRLPSEPGMTLLTIRIEKIGLKDAGQCIDPYITVSVKDLNGINLTPVPRXXXGFKKKKIHMFILMXGHWSFQKXCWXKLTQK

SEQ ID NO: 1163 - protein, 189 aa, Homo sapiens
  misc_feature (186)..(186): Xaa can be any naturally occurring amino acid
GSRFSSTLTGWLGQLRRGSQLTMGDPSKQDILTIFKRLRSVPTNKVCFDCGAKNPSWASITYGVFLCIDCSGSHRSLGVHLSFIRSTELDSNWSWFQLRCMQVGGNASASSFFHQHGCSTNDTNAKYNSRAAQLYREKIKSLASQATRKHGTDLWLDSCVVPPLSPPPKEEDFFASHVSSEVSDTXVGI

SEQ ID NO: 1164 - protein, 167 aa, Homo sapiens
  misc_feature (19)..(19): Xaa can be any naturally occurring amino acid
GEDVRGVLKRRVETRQHTXEAIRQQEVEQLDFRDLLGKKVSTKTLSEDDLKEIPAEQMDFRANLQRQVKPKTVSEEERKVHSPQQVDFRSVLAKKGTSKTPVPEKVPPPKPATPDFRSVLGGKKKLPAENGSSSAETLNAKAVESSKPLSNAQPSGPLKPVGNAQAC

SEQ ID NO: 1165 - protein, 242 aa, Homo sapiens
  misc_feature (10)..(10): Xaa can be any naturally occurring amino acid
  misc_feature (18)..(18): Xaa can be any naturally occurring amino acid
  misc_feature (36)..(36): Xaa can be any naturally occurring amino acid
  misc_feature (43)..(43): Xaa can be any naturally occurring amino acid
  misc_feature (48)..(48): Xaa can be any naturally occurring amino acid
  misc_feature (52)..(53): Xaa can be any naturally occurring amino acid
  misc_feature (64)..(64): Xaa can be any naturally occurring amino acid
  misc_feature (72)..(72): Xaa can be any naturally occurring amino acid
  misc_feature (169)..(169): Xaa can be any naturally occurring amino acid
YLQPTWDFDXRGHSMRFXDDAKDFISILLKKDMKTXLDCTQCXQHPWXMKDXXEHGGQETFQGXMKKYMARXKWQKTGNAVRAIGRLSSMAMISGLSGRKSSTGSPTSPLNAEKLESEDVSQAFLEAVAEEKPHVKPYFSKTIRDLEVVEGSAARFDCKIEGYPDPEVXWFKDDQSIRESRHFQIDYDEDGNCSLIISDVCGDDDAKYTCKAVNSLGEATCTAELIVETMEEGEGEGEEEEE

SEQ ID NO: 1166 - protein, 221 aa, Homo sapiens
  misc_feature (206)..(206): Xaa can be any naturally occurring amino acid
SGKMAKVSELYDVTWEEMRDKMRKWREENSRNSEQIVEVGEELINEYASKLGDDIWIIYEQVMIAALDYGRDDLALFCLQELRRQFPGSHRVKRLTGMRFEAMERYDDAIQLYDRILQEDPTNTAARKRKIAIRKAQGKNVEAIRELNEYLEQFVGDQEAWHELAELYINEHDYAKAAFCLEELMMTNPHNHLYCQQYAEVKYTQXGLENLDFQESILHRH

SEQ ID NO: 1167 - protein, 167 aa, Homo sapiens
HVLSLSFPIRRDDGSWEVIEGYRAQHSQHRTPCKGGIRYSTDVSVDEVKALASLMTYKCAVVDVPFGGAKAGVKINPKNYTDNELEKITRRFTMELAKKGFIGPGIDVPAPDMSTGEREMSWIADTYASTIGHYDINAHACVTGKPISQGGIHGRISATGPWCLPWD

SEQ ID NO: 1168 - protein, 112 aa, Homo sapiens
  misc_feature (5)..(7): Xaa can be any naturally occurring amino acid
  misc_feature (11)..(11): Xaa can be any naturally occurring amino acid
  misc_feature (17)..(17): Xaa can be any naturally occurring amino acid
  misc_feature (19)..(19): Xaa can be any naturally occurring amino acid
  misc_feature (21)..(21): Xaa can be any naturally occurring amino acid
  misc_feature (23)..(24): Xaa can be any naturally occurring amino acid
  misc_feature (27)..(27): Xaa can be any naturally occurring amino acid
  misc_feature (32)..(33): Xaa can be any naturally occurring amino acid
  misc_feature (35)..(35): Xaa can be any naturally occurring amino acid
  misc_feature (37)..(37): Xaa can be any naturally occurring amino acid
  misc_feature (40)..(40): Xaa can be any naturally occurring amino acid
  misc_feature (44)..(44): Xaa can be any naturally occurring amino acid
  misc_feature (46)..(48): Xaa can be any naturally occurring amino acid
  misc_feature (52)..(52): Xaa can be any naturally occurring amino acid
  misc_feature (57)..(57): Xaa can be any naturally occurring amino acid
  misc_feature (80)..(80): Xaa can be any naturally occurring amino acid
  misc_feature (82)..(82): Xaa can be any naturally occurring amino acid
  misc_feature (85)..(85): Xaa can be any naturally occurring amino acid
  misc_feature (96)..(96): Xaa can be any naturally occurring amino acid
  misc_feature (106)..(108): Xaa can be any naturally occurring amino acid
IFISXXXPYFXNKDLSXQXYXIXXGDXSSTSXXLXWXSAXDLTXRXXXPAEXSHQGXGIHEEPESFFTWFTDHSDAGADXLXEVXKDDIWPNPLQXYLVPDMDDEXXXGERR

SEQ ID NO: 1169 - protein, 67 aa, Homo sapiens
  misc_feature (49)..(49): Xaa can be any naturally occurring amino acid
THIRYNKIGVVKTMSCGNEFVETLKKIGYPKADNLNGEDFDWLFEGVEXESFLKWFCGNVNEQNVLS

SEQ ID NO: 1170 - protein, 208 aa, Homo sapiens
  misc_feature (25)..(25): Xaa can be any naturally occurring amino acid
ESSGTYIVNLENLVQELSQSNMMLXKQLEMLTDPSVSQQINPRNTIDTKDYSTHRLYQVLEGENKKKELFLTHGNLEEVAEKLKQNISLVQDQLAVSAQEHSFFLSKRNKDVDMLCDTLYQGGNQLLLSDQELTEQFHKVESQLNKLNHLLTDILADVKTKRKTLANNKLHQMEREFYVYFLKDEDYLKDIVENLETQSKIKAVSLED

SEQ ID NO: 1171 - protein, 227 aa, Homo sapiens
  misc_feature (198)..(198): Xaa can be any naturally occurring amino acid
  misc_feature (210)..(210): Xaa can be any naturally occurring amino acid
RLYNSAVVTMPVVRKIFRRRRGDSESEEDEQDSEEVRLKLEETREVQNLRKRPNGVSAVALLVGEKVQEETTLVDDPFQMKTGGMVDMKKLKERGKDKISEEEDLHLGTSFSAETNRRDEDADMMKYIETELKKRKGIVEHEEQKVKPKNAEDCLYELPENIRVSSAKKTEEMLSNQMLSGIPEVDLGIDAKIKNIIXTEDAKARLLAEXRTRKKDRETSLCLPTWL

SEQ ID NO: 1172 - protein, 209 aa, Homo sapiens
  misc_feature (11)..(11): Xaa can be any naturally occurring amino acid
  misc_feature (26)..(26): Xaa can be any naturally occurring amino acid
  misc_feature (39)..(39): Xaa can be any naturally occurring amino acid
ERLRDIYRPPXKFGSKNLSQSNMMLXKQLEMLTDPSVSXQINPRNTIDTKDYSTHRLYQVLEGENKKKELFLTHGNLEEVAEKLKQNISLVQDQLAVSAQEHSFFLSKRNKDVDMLCDTLYQGGNQLLLSDQELTEQFHKVESQLNKLNHLLTDILADVKTKRKTLANNKLHQMEREFYVYFLKDEDYLKDIVENLETQSKIKAVSLED

SEQ ID NO: 1173 - protein, 178 aa, Homo sapiens; identical to SEQ ID NO: 1130

SEQ ID NO: 1174 - protein, 166 aa, Homo sapiens; identical to SEQ ID NO: 1132

SEQ ID NO: 1175 - protein, 118 aa, Homo sapiens; identical to SEQ ID NO: 1131

SEQ ID NO: 1176 - protein, 82 aa, Homo sapiens
  misc_feature (10)..(10): Xaa can be any naturally occurring amino acid
  misc_feature (27)..(27): Xaa can be any naturally occurring amino acid
  misc_feature (32)..(32): Xaa can be any naturally occurring amino acid
  misc_feature (42)..(42): Xaa can be any naturally occurring amino acid
  misc_feature (46)..(46): Xaa can be any naturally occurring amino acid
  misc_feature (52)..(52): Xaa can be any naturally occurring amino acid
  misc_feature (65)..(65): Xaa can be any naturally occurring amino acid
  misc_feature (72)..(72): Xaa can be any naturally occurring amino acid
  misc_feature (77)..(77): Xaa can be any naturally occurring amino acid
KKCCLHMLVXETLARRISGHTNMWIGXSCSEXSWGSLKRGKXWFSXMLHMAXFKRLKTFFCPLCXAWKLPPXQCVEXLQRNL

SEQ ID NO: 1177 - protein, 44 aa, Homo sapiens
  misc_feature (5)..(5): Xaa can be any naturally occurring amino acid
  misc_feature (10)..(10): Xaa can be any naturally occurring amino acid
  misc_feature (21)..(21): Xaa can be any naturally occurring amino acid
  misc_feature (29)..(29): Xaa can be any naturally occurring amino acid
  misc_feature (34)..(35): Xaa can be any naturally occurring amino acid
TQTYXNSSIXFTSLSSICQKXGVSPDFFXLGPPXXKQIFTMLLN

SEQ ID NO: 1178 - protein, 216 aa, Homo sapiens
  misc_feature (185)..(185): Xaa can be any naturally occurring amino acid
  misc_feature (209)..(209): Xaa can be any naturally occurring amino acid
LSEKFFKAASNCGIVESILNWVKFKAQTQLNKKCSSVKYSKIKGIPKLDDANDAGGKHSLECTLILTEGDSAKSLAVSGLGVIGRDRYGVFPLRGKILNVREASHKQIMENAEINNIIKIVGLQYKKSYDDAESLKTLRYGKIMIMTDQDQDGSHIKGLLINFIHHNWPSLLKHGFLEEFITPIXKASKNKQELSFYSIPEFANGKNIXKTRKPGK

SEQ ID NO: 1179 - protein, 110 aa, Homo sapiens
  misc_feature (5)..(5): Xaa can be any naturally occurring amino acid
  misc_feature (11)..(12): Xaa can be any naturally occurring amino acid
  misc_feature (14)..(14): Xaa can be any naturally occurring amino acid
  misc_feature (18)..(18): Xaa can be any naturally occurring amino acid
  misc_feature (20)..(20): Xaa can be any naturally occurring amino acid
  misc_feature (24)..(24): Xaa can be any naturally occurring amino acid
  misc_feature (26)..(26): Xaa can be any naturally occurring amino acid
  misc_feature (36)..(36): Xaa can be any naturally occurring amino acid
  misc_feature (39)..(39): Xaa can be any naturally occurring amino acid
  misc_feature (46)..(46): Xaa can be any naturally occurring amino acid
  misc_feature (49)..(49): Xaa can be any naturally occurring amino acid
  misc_feature (54)..(54): Xaa can be any naturally occurring amino acid
  misc_feature (67)..(68): Xaa can be any naturally occurring amino acid
  misc_feature (71)..(72): Xaa can be any naturally occurring amino acid
  misc_feature (80)..(80): Xaa can be any naturally occurring amino acid
  misc_feature (93)..(93): Xaa can be any naturally occurring amino acid
  misc_feature (98)..(98): Xaa can be any naturally occurring amino acid
  misc_feature (106)..(106): Xaa can be any naturally occurring amino acid
  misc_feature (108)..(109): Xaa can be any naturally occurring amino acid
KPFSXPVLKPXXTXKTKXRXKGCXLXLGIQNLAFQXKPXPPKGKGXGAXKRKAXGFENEGDYNPGRXXSKXXSKKPKKTXFDQDSDVDIFPSXFPNEXPFLPRTGXVXXK

SEQ ID NO: 1180 - protein, 176 aa, Homo sapiens
  misc_feature (157)..(157): Xaa can be any naturally occurring amino acid
  misc_feature (159)..(159): Xaa can be any naturally occurring amino acid
  misc_feature (166)..(166): Xaa can be any naturally occurring amino acid
  misc_feature (176)..(176): Xaa can be any naturally occurring amino acid
VGRYLTLAIRMPEDLAMSYEESQDLQLCVNGCPLSERIDDGQGQVSAILGHSLPRTSLVQAWPGYTLETANTQCHEKMPVKDIYFQSCVFDLLTTGDANFTAAAHSALEDVEALHPRKERWHIFPSSGNGTPRGGSDLSVKSRTHLLDPYRVFVGVXFXFGFLFFXYNKILKYILX

SEQ ID NO: 1181 - protein, 87 aa, Homo sapiens
  misc_feature (10)..(10): Xaa can be any naturally occurring amino acid
  misc_feature (32)..(32): Xaa can be any naturally occurring amino acid
  misc_feature (52)..(52): Xaa can be any naturally occurring amino acid
  misc_feature (65)..(65): Xaa can be any naturally occurring amino acid
KKCCLHMLVXETLARRISGHTNMWIGYSCSEXSWGSLKRGKHWFSQMLHMAXFKRLKTFFCPLCXAWKLPPPHSVSSLCKETFRCGS

SEQ ID NO: 1182 - protein, 85 aa, Homo sapiens
  misc_feature (4)..(4): Xaa can be any naturally occurring amino acid
  misc_feature (10)..(10): Xaa can be any naturally occurring amino acid
  misc_feature (13)..(13): Xaa can be any naturally occurring amino acid
  misc_feature (16)..(16): Xaa can be any naturally occurring amino acid
  misc_feature (22)..(22): Xaa can be any naturally occurring amino acid
  misc_feature (37)..(37): Xaa can be any naturally occurring amino acid
  misc_feature (42)..(42): Xaa can be any naturally occurring amino acid
  misc_feature (47)..(47): Xaa can be any naturally occurring amino acid
  misc_feature (54)..(54): Xaa can be any naturally occurring amino acid
  misc_feature (61)..(61): Xaa can be any naturally occurring amino acid
  misc_feature (65)..(66): Xaa can be any naturally occurring amino acid
FRSXVKICFXIWXAQXRKKSGXYPPFFVQKYESEVKXIEEFXKDLGXECVSLIXNLCSFQXKYHXXLLDSGKRRLGYFAISFSWK

SEQ ID NO: 1183 - protein, 83 aa, Homo sapiens
  misc_feature (15)..(15): Xaa can be any naturally occurring amino acid
  misc_feature (28)..(28): Xaa can be any naturally occurring amino acid
NGGNTGFHRCSTWLXLKDSKLFFVLFVXLGSSPPPTVCRVFAKKPLDVVHRYMNTYLCKTVSVQCVNTLNYYARKIKLHTLLW

SEQ ID NO: 1184 - protein, 229 aa, Homo sapiens
  misc_feature (38)..(38): Xaa can be any naturally occurring amino acid
  misc_feature (204)..(204): Xaa can be any naturally occurring amino acid
  misc_feature (224)..(224): Xaa can be any naturally occurring amino acid
EITELKVKEFENIKLQLQENHEDEVKKVKAEVEDLKYXLDQSQKESQCLKSELQAQKEANSRAPTTTMRNLVERLKSQLALKEKQQKALSRALLELRAEMTAAAEERIISATSQKEAHLNVQQIVDRHTRELKTQVEDLNENLLKLKEALKTSKNRENSLTDNLNDLNNELQKKQKAYNKILREKEEIDQENDELKRQIKRLTXGLQGKPLTDNKPRSNWRNSXGRLKT

SEQ ID NO: 1185 - protein, 182 aa, Homo sapiens
  misc_feature (3)..(3): Xaa can be any naturally occurring amino acid
  misc_feature (7)..(7): Xaa can be any naturally occurring amino acid
  misc_feature (9)..(9): Xaa can be any naturally occurring amino acid
  misc_feature (21)..(21): Xaa can be any naturally occurring amino acid
  misc_feature (26)..(26): Xaa can be any naturally occurring amino acid
  misc_feature (31)..(32): Xaa can be any naturally occurring amino acid
  misc_feature (49)..(49): Xaa can be any naturally occurring amino acid
  misc_feature (77)..(77): Xaa can be any naturally occurring amino acid
  misc_feature (93)..(93): Xaa can be any naturally occurring amino acid
  misc_feature (100)..(100): Xaa can be any naturally occurring amino acid
  misc_feature (130)..(130): Xaa can be any naturally occurring amino acid
  misc_feature (143)..(143): Xaa can be any naturally occurring amino acid
  misc_feature (166)..(166): Xaa can be any naturally occurring amino acid
CKXGPQXGXQKGFPNPMKPLXTRLRXLNHVXXGVETEQAFKGSFQVFRXANHPADKEKAELIHQIEATKDQSGAESXIPDADQLKEKIKDLEXQLKMSDXEKQHLKEEIKKLKKELENFDPSFFEEIEDXKYNYKEEVKKNIXLEEKVKKLSEQLGVELTSPVAAXEEFEDEEESPVNFPIY

SEQ ID NO: 1186 - protein, 118 aa, Homo sapiens; identical to SEQ ID NO: 1135

SEQ ID NO: 1187 - protein, 84 aa, Homo sapiens
  misc_feature (12)..(12): Xaa can be any naturally occurring amino acid
  misc_feature (18)..(18): Xaa can be any naturally occurring amino acid
  misc_feature (27)..(27): Xaa can be any naturally occurring amino acid
  misc_feature (69)..(69): Xaa can be any naturally occurring amino acid
CNTCPLRAQHHXQGNKSXDPKLKEVDXVLGGAAAWENVDSTAESCPKCEHPRAYFMQLQTRSADEPMTXFYKCCNAQCGHRWRD

SEQ ID NO: 1188 - protein, 190 aa, Homo sapiens
LQDIKEKISKGEYGNAGIMAEVEELRKRVLDMEGKDEELIKMEEQCRDLNKRLERETLQSKDFKLEVEKLSKRIMALEKLEDAFNKSKQECYSLKCNLEKERMTTKQLSQELESLKVRIKELEAIESRLEKTEFTLKEDLTKLKTLTVMFVDERKTMSEKLKKTEDKLQAASSQLQVEQNKVTTVTEKVN

SEQ ID NO: 1189 - protein, 214 aa, Homo sapiens
VRVDSTAKVAEIEHAEKEKMKEKVERILKHGINCFINRQLIYNYPEQLFGAAGVMAIEHADFAGVERLALVTGGEIASTFDHPELVKLGSCKLIEEVMIGEDKLIHFSGVALGEACTIVLRGATQQILDEAERSLHDALCVLAQTVKDSRTVYGGGCSEMLMAHAVTQLANRTPGKEAVAMESYAKALRMLPTIIADNAAMTVQTWWHSSRLLQ

SEQ ID NO: 1190 - protein, 245 aa, Homo sapiens
  misc_feature (203)..(203): Xaa can be any naturally occurring amino acid
  misc_feature (217)..(217): Xaa can be any naturally occurring amino acid
  misc_feature (221)..(221): Xaa can be any naturally occurring amino acid
  misc_feature (223)..(223): Xaa can be any naturally occurring amino acid
  misc_feature (233)..(233): Xaa can be any naturally occurring amino acid
SRTRTSDRLNRIANQVAIQRKKQFVERAHSYWLLKRLSRNGAPLLRRLQSSLQSQRSSQQRENDEEMKAAKEKLKYWQRLRHDLERARLLIELLRKREKLKREQVKVEQVAMELRLTPLTVLLRSVLDQLQDKDPARIFAQPVSLKEVPDYLDHIKHPMDFATMRKRLEAQGYKNLHEFEEDFDLIIDNCMKYNARDTVFYKXRGEACAIKEVLFLXQAPXRXGTSIRLGKRXSGIAPCLKPGLL

SEQ ID NO: 1191 - protein, 190 aa, Homo sapiens
  misc_feature (182)..(182): Xaa can be any naturally occurring amino acid
  misc_feature (186)..(186): Xaa can be any naturally occurring amino acid
PEAETTGCGAAGRDTCSPFDPIMSRGSIEIPLRDTDEVIELDFDQLPEGDEVISILKQEHTQLHIWIALALEYYKQGKTEEFVKLLEAARIDGNLDYRDHEKDQMTCLDTLAAYYVQQARKEKNKDNKKDLITQATLLYTMADKIIMYDQNHLLGRACFCLLEGDKMDQADAQFHFVLNQSXNNIXSPSW

SEQ ID NO: 1192 - protein, 114 aa, Homo sapiens
AEAGSSQQMVLIIHNNFIGHCIQQGGLCNKILFIVLILFFPSLLYIIRCQCIQASHLVFFMVSIVQIAIYTCCFQQFYKLFCFSLLVVFQRQSNPYVQLCVFLFQNTDNFISLR

SEQ ID NO: 1193 - protein, 40 aa, Homo sapiens
  misc_feature (11)..(11): Xaa can be any naturally occurring amino acid
  misc_feature (13)..(13): Xaa can be any naturally occurring amino acid
  misc_feature (18)..(18): Xaa can be any naturally occurring amino acid
  misc_feature (27)..(27): Xaa can be any naturally occurring amino acid
KRFLTNEGSGXKXLEMNXNQRDPPPKXSDKGSEHGSDDSD

SEQ ID NO: 1194 - protein, 196 aa, Homo sapiens
  misc_feature (3)..(3): Xaa can be any naturally occurring amino acid
  misc_feature (195)..(195): Xaa can be any naturally occurring amino acid
ERXLERARERDKERERQRDWEDKDKGRDDRREKREEIREDRNPRDGHDERKSKKRYRNEGSPSPRQSPKRRREHSPDSDAYNSGDDKNEKHRLLSQVVRPQESRSLSPSHLTEDRQGRWKEEDRKPERKESSRRYEEQELKEKVSSVDKQREQTEILESSRMRAQDIIGHHQSEDRETSDRALMKTRRKPKFKEXI

SEQ ID NO: 1195 - protein, 194 aa, Homo sapiens
  misc_feature (7)..(7): Xaa can be any naturally occurring amino acid
  misc_feature (10)..(10): Xaa can be any naturally occurring amino acid
  misc_feature (12)..(12): Xaa can be any naturally occurring amino acid
  misc_feature (18)..(21): Xaa can be any naturally occurring amino acid
  misc_feature (26)..(28): Xaa can be any naturally occurring amino acid
  misc_feature (31)..(31): Xaa can be any naturally occurring amino acid
  misc_feature (43)..(43): Xaa can be any naturally occurring amino acid
  misc_feature (58)..(58): Xaa can be any naturally occurring amino acid
  misc_feature (72)..(72): Xaa can be any naturally occurring amino acid
  misc_feature (78)..(80): Xaa can be any naturally occurring amino acid
  misc_feature (90)..(90): Xaa can be any naturally occurring amino acid
  misc_feature (96)..(97): Xaa can be any naturally occurring amino acid
  misc_feature (99)..(99): Xaa can be any naturally occurring amino acid
  misc_feature (101)..(101): Xaa can be any naturally occurring amino acid
  misc_feature (109)..(110): Xaa can be any naturally occurring amino acid
  misc_feature (118)..(118): Xaa can be any naturally occurring amino acid
  misc_feature (120)..(120): Xaa can be any naturally occurring amino acid
  misc_feature (122)..(122): Xaa can be any naturally occurring amino acid
  misc_feature (127)..(127): Xaa can be any naturally occurring amino acid
  misc_feature (131)..(131): Xaa can be any naturally occurring amino acid
  misc_feature (139)..(139): Xaa can be any naturally occurring amino acid
  misc_feature (160)..(161): Xaa can be any naturally occurring amino acid
  misc_feature (163)..(163): Xaa can be any naturally occurring amino acid
  misc_feature (166)..(166): Xaa can be any naturally occurring amino acid
  misc_feature (174)..(174): Xaa can be any naturally occurring amino acid
  misc_feature (176)..(176): Xaa can be any naturally occurring amino acid
  misc_feature (178)..(178): Xaa can be any naturally occurring amino acid
  misc_feature (192)..(194): Xaa can be any naturally occurring amino acid
EKSEKKXIKXEXPKGLGXXXXKAEMXXXKSXKRSEKIGIQEMXMMKENQRSGYRNEGXPSPRQSPKRRGEHXPDSDAXXXGDDKNEKPRXLSQVVXXQXFXFFSPSPLXXDRQGRWKXEXCXPERKXSSRXYEEQELKXKVFFVDKQREQTEILESSRMXXQXIIXPPQFEDRXTXDXAHDENKKKAKIQKXXX

SEQ ID NO: 1196 - protein, 232 aa, Homo sapiens
  misc_feature (193)..(193): Xaa can be any naturally occurring amino acid
  misc_feature (198)..(198): Xaa can be any naturally occurring amino acid
  misc_feature (204)..(204): Xaa can be any naturally occurring amino acid
  misc_feature (210)..(210): Xaa can be any naturally occurring amino acid
  misc_feature (225)..(225): Xaa can be any naturally occurring amino acid
QDLYSARDLQGLTVEHAIDSFREGETMILTLKDKGVLQEEEDVLVNVNLVDKERAEKNVELRKKKPDYLPYAEDESVDDLAQQKPRSILSKYDEELEGERPHSFRLEQGGTADGLRERELEEIRAKLRLQAQSLSTVGPRLASEYLTPEEMVTFKKTKRRVKKIRKKEKEVVVRADDLLPLGDQTQDGDFGSXTAGDXVPPQCXEWRKKXEPCALTPGVGRHPNXRTLDIID

SEQ ID NO: 1197 - protein, 165 aa, Homo sapiens
  misc_feature (38)..(38): Xaa can be any naturally occurring amino acid
IGGWQLPCSCVRTKGCWRPQSEGGPGKAPNKSLPSAVXCIEDKMAIDDKYSRREEYRGFTQDFKEKDGYKPDVKIEYVDETGRKLTPKEAFRQLSHRFHGKGSGKMKTERRMKKLDEEALLKKMSSSDTPLGTVALLQEKQKAQKTPYIVLSGSGKSMNANTITK

SEQ ID NO: 1198 - protein, 206 aa, Homo sapiens
  misc_feature (204)..(204): Xaa can be any naturally occurring amino acid
KMAKVSELYDVTWEEMRDKMRKWREENSRNSEQIVEVGEELINEYASKLGDDIWIIYEQVMIAALDYGRDDLALFCLQELRRQFPGSHRVKRLTGMRFEAMERYDDAIQLYDRILQEDPTNTAARKRKIAIRKAQGKNVEAIRELNEYLEQFVGDQEAWHELAELYINEHDYAKAAFCLEELMMTNPHNHLYCQQYAEVKYTQXWT

SEQ ID NO: 1199 - protein, 62 aa, Homo sapiens
  misc_feature (13)..(13): Xaa can be any naturally occurring amino acid
  misc_feature (50)..(50): Xaa can be any naturally occurring amino acid
CQQYAEVKYTQGXLETLELSRKYFAQALKLNNRNMRALFGLYMSASHIAXNPKASAKTKKAT

SEQ ID NO: 1200 - protein, 147 aa, Homo sapiens [sequence omitted]

SEQ ID NO: 1201 - protein, 71 aa, Homo sapiens
SNITLLLTGLNILVTALYSLYIFTTTQWGSLTHHINNIKPSFTRENTLMFIHLSPILLLSLNPDIITGFSS

SEQ ID NO: 1202 - protein, 93 aa, Homo sapiens
AHHSLIENNRNQIIQALLITILLGLYFTLLQASEYFESPFTISDGIYGSTFFVATGFHGLHVIIGSTFLTICFIRQLIFHFTSKHHFGFEAAA

SEQ ID NO: 1203 - protein, 159 aa, Homo sapiens
  misc_feature (6)..(6): Xaa can be any naturally occurring amino acid
  misc_feature (14)..(14): Xaa can be any naturally occurring amino acid
  misc_feature (18)..(18): Xaa can be any naturally occurring amino acid
  misc_feature (25)..(25): Xaa can be any naturally occurring amino acid
  misc_feature (32)..(33): Xaa can be any naturally occurring amino acid
  misc_feature (36)..(36): Xaa can be any naturally occurring amino acid
  misc_feature (39)..(39): Xaa can be any naturally occurring amino acid
  misc_feature (45)..(45): Xaa can be any naturally occurring amino acid
  misc_feature (53)..(53): Xaa can be any naturally occurring amino acid
  misc_feature (74)..(76): Xaa can be any naturally occurring amino acid
  misc_feature (78)..(79): Xaa can be any naturally occurring amino acid
  misc_feature (96)..(96): Xaa can be any naturally occurring amino acid
  misc_feature (101)..(102): Xaa can be any naturally occurring amino acid
  misc_feature (106)..(106): Xaa can be any naturally occurring amino acid
  misc_feature (108)..(108): Xaa can be any naturally occurring amino acid
  misc_feature (113)..(113): Xaa can be any naturally occurring amino acid
  misc_feature (123)..(124): Xaa can be any naturally occurring amino acid
  misc_feature (127)..(127): Xaa can be any naturally occurring amino acid
  misc_feature (140)..(140): Xaa can be any naturally occurring amino acid
  misc_feature (144)..(144): Xaa can be any naturally occurring amino acid
  misc_feature (156)..(156): Xaa can be any naturally occurring amino acid
VSSRYXPNEGSHHXFLKXQRKSKSXKIIFNYXXDAXREXTLVSEXAQRAQREXQCQMKEAEHMYQNEQDNVNKXXXQXXSLDQKLFQLQSKNMWLXQQLVXXHKKXAXKSKIXIDIHFLERKXXHHXLKEKNEEIFNSNXHLKXRIYQYEKEKAEXENS

SEQ ID NO: 1204 - protein, 53 aa, Homo sapiens
SQPYTPSTYLPQHNGAHSPHINNIKPSFTRENTLMSYTYPHSLYSSTRILPGF

SEQ ID NO: 1205 - protein, 71 aa, Homo sapiens; identical to SEQ ID NO: 1201

SEQ ID NO: 1206 - protein, 279 aa, Homo sapiens
  misc_feature (229)..(229): Xaa can be any naturally occurring amino acid
  misc_feature (240)..(240): Xaa can be any naturally occurring amino acid
  misc_feature (264)..(264): Xaa can be any naturally occurring amino acid
EIHRKLSEATRELQNAPDAIPESGVEPPALDTAWVEATRKKALLKLEKLDTDLKNYKGNSIKESIRRGHDDLGDHYLDCGDLSNALKCYSRARDYCTSAKHVINMCLNVIKVSVYLQNWSHVLSYVSKAESTPEIAEQRGERDSQTQAILTKLKCAAGLAELAARKYKQAAKCLLLASFDHCDFPELLSPSNVAIYGGLCALATFDRQELQRNVIFSSSFKLFLELEPXVRDIIFKFYEXKYASCLKNAGPRMKGQPCSLDIVXWAPIVKDPCTPQISK

SEQ ID NO: 1207 - protein, 178 aa, Homo sapiens
  misc_feature (163)..(163): Xaa can be any naturally occurring amino acid
  misc_feature (166)..(166): Xaa can be any naturally occurring amino acid
EIHRKLSEATRELQNAPDAIPESGVEPPALDTAWVEATRKKALLKLEKLDTDLKNYKGNSIKESIRRGHDDLGDHYLDCGDLSNALKCYSRARDYCTSAKHVINMCLNVIKVSVYLQNWSHVLSYVSKAESTPEIAEQRGERDSQTQAILTKLKCAASLAKLXARXYKQACQVLCWLL

SEQ ID NO: 1208 - protein, 120 aa, Homo sapiens
  misc_feature (16)..(16): Xaa can be any naturally occurring amino acid
  misc_feature (27)..(27): Xaa can be any naturally occurring amino acid
  misc_feature (29)..(29): Xaa can be any naturally occurring amino acid
  misc_feature (44)..(44): Xaa can be any naturally occurring amino acid
  misc_feature (56)..(57): Xaa can be any naturally occurring amino acid
  misc_feature (68)..(68): Xaa can be any naturally occurring amino acid
SFQYFKPLRFKPTMHXMGQPFKYHGAXLXGRVDAVNLEGVDQCXCGLTQARSYTAXXVDQRSTTFEKXLLMGKEFQRRAKAMMLRAAVLRNQIHVKSPPREGSQGELTPANSQSRMSTNM

SEQ ID NO: 1209 - protein, 182 aa, Homo sapiens
  misc_feature (159)..(159): Xaa can be any naturally occurring amino acid
GVEPPALDTAWVEATRKKALLKLEKLDTDLKNYKGNSIKESIRRGHDDLGDHYLDCGDLSNALKCYSRARDYCTSAKHVINMCLNVIKVSVYLQNWSHVLSYVSKAESTPEIAEQRGERDSQTQAILTKLKCAAGLAELAARKYKQAAKCLLLASFDHXDFPELLSPNNVAIYGGLCALATF

SEQ ID NO: 1210 - protein, 239 aa, Homo sapiens
  misc_feature (189)..(189): Xaa can be any naturally occurring amino acid
  misc_feature (200)..(200): Xaa can be any naturally occurring amino acid
  misc_feature (224)..(224): Xaa can be any naturally occurring amino acid
KKALLKLEKLDTDLKNYKGNSIKESIRRGHDDLGDHYLDCGDLSNALKCYSRARDYCTSAKHVINMCLNVIKVSVYLQNWSHVLSYVSKAESTPEIAERGERDSQTQAILTKLKCAAGLAELAARKYKQAAKCLLLASFDHCDFPELLSPSNVAIYGGLCALATFDRQELQRNVIFSSSFKLFLELEPXVRDIIFKFYEXKYASCLKNAGPRMKGQPCSLDIVXWAPIVKDPCTPQISK

SEQ ID NO: 1211 - protein, 245 aa, Homo sapiens
  misc_feature (190)..(190): Xaa can be any naturally occurring amino acid
  misc_feature (200)..(200): Xaa can be any naturally occurring amino acid
  misc_feature (207)..(207): Xaa can be any naturally occurring amino acid
  misc_feature (219)..(219): Xaa can be any naturally occurring amino acid
  misc_feature (224)..(224): Xaa can be any naturally occurring amino acid
  misc_feature (230)..(230): Xaa can be any naturally occurring amino acid
  misc_feature (241)..(241): Xaa can be any naturally occurring amino acid
KKALLKLEKLDTDLKNYKGNSIKESIRRGHDDLGDHYLDCGDLSNALKCYSRARDYCTSAKHVINMCLNVIKVSVYLQNWSHVLSYVSKAESTPEIAERGERDSQTQAILTKLKCAAGLAELAARKYKQAAKCLLLASFDHCDFPELLSPSNVAIYGGLCALATFDRQELQRNVIFSSFFKLFLELEPQXRDIIFKFYEXQVPLMFXRCLDENERTTLXLDNVXWPPLLXTLYNPKFRNRXPSFS

SEQ ID NO: 1212 - protein, 210 aa, Homo sapiens
SEMIFSDMNTVSGSPKVHPPNGTRFYTFQEFAALTKELNACREQLLEKEEEISELKAERNNTRLLLEHLECLVSRHERSLRMTVVKRQAQSPSGVSSEVEVLKALKSLFEHHKALDEKVRERLRVSLERVSALEEELAAANQEIVALREQNVHIQRKMASSEGSTESEHLEGMEPGQKVHEKRLSNGSIDSTDETSQIVELQELLEKQNQ

SEQ ID NO: 1213 - protein, 97 aa, Homo sapiens
SEMIFSDMNTVSGSPKVHPPNGTRFYTFQEFAALTKELNACREQLLEKEEEISELKAERNNTRLLLEHLECLVSRHERSLRMTVVKRQAQSPSGVSK

SEQ ID NO: 1214 - protein, 209 aa, Homo sapiens
EMIFSDMNTVSGSPKVHPPNGTRFYTFQEFAALTKELNACREQLLEKEEEISELKAERNNTRLLLEHLECLVSRHERSLRMTVVKRQAQSPSGVSSEVEVLKALKSLFEHHKALDEKVRERLRVSLERVSALEEELAAANQEIVALREQNVHIQRKMASSEGSTESEHLEGMEPGQKVHEKRLSNGSIDSTDETSQIVELQELLEKQNQ

SEQ ID NO: 1215 - protein, 98 aa, Homo sapiens
  misc_feature (98)..(98): Xaa can be any naturally occurring amino acid
GGMNDLFFQEFAALTKELNACREQLLEKEEEISELKAERNNTRLLLEHLECLVSRHERSLRMTVVKRQAQSPSGVSSEVEVLKALKSLFEPTRPWMKX

SEQ ID NO: 1216 - protein, 214 aa, Homo sapiens
  misc_feature (1)..(1): Xaa can be any naturally occurring amino acid
  misc_feature (7)..(7): Xaa can be any naturally occurring amino acid
  misc_feature (10)..(10): Xaa can be any naturally occurring amino acid
  misc_feature (123)..(123): Xaa can be any naturally occurring amino acid
  misc_feature (196)..(196): Xaa can be any naturally occurring amino acid
XQRTNFXLKXIFSLPSGHSDAQTLAMMLQEQLDAINKEIRLIQEEKESTELRAEEIENRVASVSLEGLNLARVHPGTSITASVTASSLASSSPPSGHSTPKLTPRSPAREMDRMGVMTLPSDXRKHRRKIAVVEEDGREDKATIKCETSPPPTPRALRMTHTLPSSYHNDARSSLSVSLEPESLGLGSANSSQDSXHKAPKKKGIKSSIGRLFG

SEQ ID NO: 1217 - protein, 63 aa, Homo sapiens
  misc_feature (17)..(17): Xaa can be any naturally occurring amino acid
  misc_feature (28)..(28): Xaa can be any naturally occurring amino acid
  misc_feature (33)..(33): Xaa can be any naturally occurring amino acid
  misc_feature (45)..(45): Xaa can be any naturally occurring amino acid
  misc_feature (49)..(49): Xaa can be any naturally occurring amino acid
  misc_feature (59)..(59): Xaa can be any naturally occurring amino acid
LLLIRRWWPCVNQNVHXQRKMASSRGIXQSQNXFEGMEPGTESPXKSVXPMGFLDLTRXKLVQ

SEQ ID NO: 1218 - protein, 169 aa, Homo sapiens
RCEPFTMKMLKDIKEGVKQYGSNSPYIRTLLDSIAHGNRLTPYDWEILAKSSLSSSQYLQFKTWWIDGVQEQVRKNQATKPTVNIDADQLLGTGPNWSTINQQSVMQNEAIEQVRAICLRAWGKIQDPGTAFPINSIRQGSKEPYPALWQDYKMLLKSLLQMTMPEKLL

SEQ ID NO: 1219 - protein, 224 aa, Homo sapiens
  misc_feature (7)..(7): Xaa can be any naturally occurring amino acid
  misc_feature (9)..(9): Xaa can be any naturally occurring amino acid
  misc_feature (14)..(14): Xaa can be any naturally occurring amino acid
  misc_feature (20)..(20): Xaa can be any naturally occurring amino acid
  misc_feature (27)..(27): Xaa can be any naturally occurring amino acid
  misc_feature (29)..(30): Xaa can be any naturally occurring amino acid
  misc_feature (41)..(41): Xaa can be any naturally occurring amino acid
  misc_feature (57)..(57): Xaa can be any naturally occurring amino acid
  misc_feature (189)..(189): Xaa can be any naturally occurring amino acid
WMIRLNXAXLIWFXQNVRKXNFPILYXSXXEPHLIYQGPLXKANDQADLLVSSAFMXAQELHALTHVNAIGLKNKFDITWKQPKNIVQHCTQCQILHLATQEARVNPRGLCPNVLWQMDVMHVPSFGKLSFVHVTVDTYSHFIWATCQTGESTSHVKRHLLSCFPVMGVPEKVKTDNGPGYCSKAFQKXLNQWKITHTIGILYNSQGQAIIERTNRTLKAQLVK

SEQ ID NO: 1220 - protein, 178 aa, Homo sapiens
QPTAMASNSPATQDAALYPQPPTVRLNPTASRSGQGGALHAVIDEARKQGDLEAWRFLVILQLVQAGEETQVGAPARAETRCEPFTMKMLKDIKEGVKQYGSNSPYIRTLLDSIAHGNRLTPYDWEILAKSSFHPLSIYSLKPGGLMEYKEQVRKNQATNPCYIDADQLLGTGQIGAH

SEQ ID NO: 1221 - protein, 152 aa, Homo sapiens
KINLISHGNRQKILYNIAPSVRFYTWPLRRQELIPEVYVLMCYGKWMSCTVPSFGKLSFVHVTVDTYSHFIWATCQTGESTSHVKRHLLSCFPVMGVPEKVKTDNGPGYCSKAFQKFLNQWKITHTIGILYNSQGQAIIERTNRTLKAQLVK

SEQ ID NO: 1222 - protein, 231 aa, Homo sapiens [sequence omitted]

SEQ ID NO: 1223 - protein, 299 aa, Homo sapiens
EEGSRGGREGAGKMVVTRSARAKASIQAASAESSGQKSFAANGIQAHPESSTGSDARTTAESQTTGKQSLIPRTPKARKRKSRTTGSLPKGTEPSTDGETSEAESNYSVSEHHDTILRVTRRRQILIACSPVSSVRKKPKVTPTKESYTEEIVSEAESHVSGISRIVLPTEKTTGARRSKAKSLTDPSQESHTEAISDAETSSSDISFSGIATRRTRSMQRKLKAQTEKKDSKIVPGNEKQIVGTPVNSEDSDTRQTSHLQARSLSEINKPNFYNNDFDDDFSHRSSENILTVHRTGQC

SEQ ID NO: 1224 - protein, 182 aa, Homo sapiens
  misc_feature (152)..(152): Xaa can be any naturally occurring amino acid
  misc_feature (166)..(166): Xaa can be any naturally occurring amino acid
VTRSARAKASIQAASAESSGQKSFAANGIQAHPESSTGSDARTTAESQTTGKQSLIPRTPKARKRKSRTTGSLPKGTEPSTDGETSEAESNYSVSEHHDTILRVTRRRQILIACSPVSSVRKKPKVTPTKESYTEEIVSEAESHVSGISRIXLPTEKTTGARRSKXKSLDRSNQESHTRNYI

SEQ ID NO: 1225 - protein, 194 aa, Homo sapiens
  misc_feature (9)..(9): Xaa can be any naturally occurring amino acid
  misc_feature (19)..(19): Xaa can be any naturally occurring amino acid
  misc_feature (23)..(23): Xaa can be any naturally occurring amino acid
  misc_feature (30)..(31): Xaa can be any naturally occurring amino acid
  misc_feature (33)..(33): Xaa can be any naturally occurring amino acid
  misc_feature (35)..(35): Xaa can be any naturally occurring amino acid
  misc_feature (42)..(42): Xaa can be any naturally occurring amino acid
  misc_feature (58)..(58): Xaa can be any naturally occurring amino acid
  misc_feature (65)..(65): Xaa can be any naturally occurring amino acid
  misc_feature (74)..(74): Xaa can be any naturally occurring amino acid
  misc_feature (79)..(79): Xaa can be any naturally occurring amino acid
  misc_feature (99)..(99): Xaa can be any naturally occurring amino acid
  misc_feature (102)..(102): Xaa can be any naturally occurring amino acid
  misc_feature (114)..(114): Xaa can be any naturally occurring amino acid
  misc_feature (138)..(138): Xaa can be any naturally occurring amino acid
  misc_feature (142)..(142): Xaa can be any naturally occurring amino acid
  misc_feature (160)..(160): Xaa can be any naturally occurring amino acid
  misc_feature (170)..(170): Xaa can be any naturally occurring amino acid
SIALGLRIXQLGGLYINFXADKXQFNKRTXXQXKXKKKNEFXQKAVITPDFEKNHCVXPYSESKXQLQKKRRKXRQKPXGDGWFGMKAPEMTNELKNDXKAXKMRASMDPKRFXKKNDRDGFPKYFQIGTIVDNPADXYHSXIPKKQRKRTIVEELLADXEFRRYNRRKXSEIMAEKAANAAGKKFRKKKKFRN

SEQ ID NO: 1226 - protein, 188 aa, Homo sapiens
SHDTILRVTRRRQILIACSPVSSVRKKPKVTPTKESYTEEIVSEAESHVSGISRIVLPTEKTTGARRSKAKSLTDPSQESHTEAISDAETSSSDISFSGIATRRTRSMQRKLKAQTEKKDSKIVPGNEKQIVGTPVNSEDSDTRQTSHLQARSLSEINKPNFYNNDFDDDFSHRSSENILTVHRTGQC

SEQ ID NO: 1227 - protein, 199 aa, Homo sapiens
  misc_feature (134)..(134): Xaa can be any naturally occurring amino acid
  misc_feature (153)..(153): Xaa can be any naturally occurring amino acid
  misc_feature (158)..(158): Xaa can be any naturally occurring amino acid
  misc_feature (162)..(162): Xaa can be any naturally occurring amino acid
  misc_feature (167)..(167): Xaa can be any naturally occurring amino acid
  misc_feature (171)..(171): Xaa can be any naturally occurring amino acid
  misc_feature (178)..(178): Xaa can be any naturally occurring amino acid
  misc_feature (186)..(186): Xaa can be any naturally occurring amino acid
EEGSRGGREGAGKMVVTRSARAKASIQAASAESSGQKSFAANGIQAHPESSTGSDARTTAESQTTGKQSLIPRTPKARKRKSRTTGSLPKGTEPSTDGETSEAESNYSVSEHHDTILRVTRRRQILIACSPVSXVRKKPKVTPTKESYTEEIXSEAKXHVSXISRIXLPTXKTTGARXSKAKSLTXPSQESHTEAISDA

SEQ ID NO: 1228 - protein, 132 aa, Homo sapiens
  misc_feature (52)..(52): Xaa can be any naturally occurring amino acid
  misc_feature (71)..(71): Xaa can be any naturally occurring amino acid
IKDQLQKKRRKERQKTAGDGWFGMKAPEMTNELKNDLKALKMRASMDPKRFXKKNDRDGFPKYFQIGTIVXNPADFYHSRIPKKQRKRTIVEELLADSEFRRYNRRKYSEIMAEKAANAAGKKFRKKKKFRN

SEQ ID NO: 1229 - protein, 117 aa, Homo sapiens
SPSILSDSSSCEIAYQDAVNLQNYVEEKLIPTWNWMVSIMDSTEAQLRYGSALASAGDPGHPNHPLHASQNSARRERMTAREEASLRTLEGRRRATLLSARQGMMSARGDFLNYALL

SEQ ID NO: 1230 - protein, 143 aa, Homo sapiens
DDIEQETFMLDEPLERTTNSSHANGAAQAPRSMQWAVRNTQHQRAASTAPSSTSTPAASSAGLIYIDPSNLRRSGTISTSAAAAAAALEASNASSYLTSASSLARAYSIVIRQISDLMGLIPKYNHLVYSQIPAAVKLLTKMQ

SEQ ID NO: 1231 - protein, 140 aa, Homo sapiens
LARAYSIVIRQISDLMGLIPKYNHLVYSQIPAAVKLTYQDAVNLQNYVEEKLIPTWNWMVSIMDSTEAQLRYGSALASAGDPGHPNHPLHASQNSARRERMTAREEASLRTLEGRRRATLLSARQGMMSARGDFLNYALL

SEQ ID NO: 1232 - protein, 143 aa, Homo sapiens; identical to SEQ ID NO: 1230

SEQ ID NO: 1233 - protein, 93 aa, Homo sapiens
  misc_feature (8)..(8): Xaa can be any naturally occurring amino acid
  misc_feature (18)..(18): Xaa can be any naturally occurring amino acid
  misc_feature (20)..(20): Xaa can be any naturally occurring amino acid
FFQFKRWXWSIVEKMSMXDXQDLVYFWTSSPSLPASEEGFQPMPSITIRPPDDQHLPTANTCISRLYVPLYSSKQILKQKLLLAIKTKNFGFV

SEQ ID NO: 1234 - protein, 196 aa, Homo sapiens
RVPVVIAGVVYCQEALRDWGRVTASSTGAMAFLRSMWGVLSALGRSGAELCTGCGSRLRSPFSFVYLPRWFSSVLASCPKKPVSSYLRFSKEQLPIFKAQNPDAKTTELIRRIAQRWRELPDSKKKIYQDAYRAEWQVYKEEISRFKEQLTPSQIMSLEKEIMDKHLKRKAMTKKKELTLLGKPKRPRSAYNRLCS

SEQ ID NO: 1235 - protein, 58 aa, Homo sapiens
WKNLSDSEKELYIQHAKEDETRYHNEMKSWEEQMIEVGRKDLLRRTIKKQRKYGAEEC

SEQ ID NO: 1236 - protein, 196 aa, Homo sapiens; identical to SEQ ID NO: 1234

SEQ ID NO: 1237 - protein, 225 aa, Homo sapiens
  misc_feature (201)..(201): Xaa can be any naturally occurring amino acid
SAHSRLAARHYSGPGPAPARPRRRQFRLKKLIDQEIKSQEEKEQEKEKRVTTLKEELTKLKSFALMVVDEQQRLTAQLTLQRQKIQELTTNAKETHTKLALAEARVQEEEQKATRLEKELQTQTTKFHQDQDTIMAKLTNEDSQNRQLQQKLAALSRQIDELEETNRSLRKAEEELQDIKEKISKGEYGNAGIMAEVEELXKRVLDMEGKDEELIKMEGAVQRSQ

SEQ ID NO: 1238 - protein, 95 aa, Homo sapiens
GGRQSLPLTLYFQGDTDYKKRNSALGKKALPGLTVQHSLASGILSLLTVYITTLVHSGHFSFLESPVDLTPMPMIFFSWLIKNSLFLLRHPCHYK

SEQ ID NO: 1239 - protein, 113 aa, Homo sapiens
  misc_feature (11)..(11): Xaa can be any naturally occurring amino acid
  misc_feature (18)..(18): Xaa can be any naturally occurring amino acid
  misc_feature (23)..(23): Xaa can be any naturally occurring amino acid
  misc_feature (27)..(28): Xaa can be any naturally occurring amino acid
  misc_feature (35)..(35): Xaa can be any naturally occurring amino acid
  misc_feature (42)..(42): Xaa can be any naturally occurring amino acid
  misc_feature (44)..(44): Xaa can be any naturally occurring amino acid
TEVRASQVVFXTSVSPKXSSLQXDMRXXRGKKVFXVLHLQKXVXSQDPLGATRGPAQCQQWTPPAGTPPGARAGPPGVVACTEGTTYVCSVCPAKFDQIEQFNDHMRMHVSDG

SEQ ID NO: 1240 - protein, 177 aa, Homo sapiens
  misc_feature (124)..(125): Xaa can be any naturally occurring amino acid
  misc_feature (130)..(130): Xaa can be any naturally occurring amino acid
  misc_feature (132)..(132): Xaa can be any naturally occurring amino acid
  misc_feature (142)..(142): Xaa can be any naturally occurring amino acid
  misc_feature (147)..(147): Xaa can be any naturally occurring amino acid
  misc_feature (151)..(151): Xaa can be any naturally occurring amino acid
AACCGTAAAFLLGRRGQVAGPRQQSPPGPGGAAERAAGHARPHLRYEVQRLPEQAGKAAQKGNCPSPKQAEPAAQPAPAHGARLGRLRRGRSCAGARRRAKKSFRGWRLFCSQGKGRGAHAETXXVEEEXPXKAPGRRSSPXAFGVXRANXEPGRGPWGRKATPRRPWAFEFKIFFQ

SEQ ID NO: 1241 - protein, 270 aa, Homo sapiens
  misc_feature (217)..(218): Xaa can be any naturally occurring amino acid
  misc_feature (223)..(224): Xaa can be any naturally occurring amino acid
  misc_feature (235)..(235): Xaa can be any naturally occurring amino acid
  misc_feature (240)..(240): Xaa can be any naturally occurring amino acid
  misc_feature (244)..(244): Xaa can be any naturally occurring amino acid
LKEVPDYLDHIKHPMDFATMRKRLEAQGYKNLHEFEEDFDLIIDNCMKYNARDTVFYRAAVRLRDQGGVVLRQARREVDSIGLEEASGMHLPERPAAAPRRPFSWEDVDRLLDPANRAHLGLEEQLRELLDMLDLTCAMKSSGSRSKRAKLLKKEIALLRNKLSQQHSQPLPTGPGLEGFEEDGAALGPGGGRRSPSEVGDSSAAKEKVAEHMRRLXXWRRSXXEKRLDAGLHQXLLGCXEPTXNPAGGLGGGRPHPDDLGPSSSRFSFK

SEQ ID NO: 1242 - protein, 66 aa, Homo sapiens
  misc_feature (12)..(12): Xaa can be any naturally occurring amino acid
  misc_feature (36)..(36): Xaa can be any naturally occurring amino acid
MFNNFVNHALYXEYHLFNKTGCKFTMTNVYFKKENXIILNGTLWKEGRIKLCCDITCRSPKTLRCP

SEQ ID NO: 1243 - protein, 85 aa, Homo sapiens [sequence omitted]

SEQ ID NO: 1244 - protein, 56 aa, Homo sapiens
  misc_feature (4)..(4): Xaa can be any naturally occurring amino acid
  misc_feature (27)..(27): Xaa can be any naturally occurring amino acid
  misc_feature (31)..(31): Xaa can be any naturally occurring amino acid
  misc_feature (34)..(34): Xaa can be any naturally occurring amino acid
  misc_feature (40)..(42): Xaa can be any naturally occurring amino acid
VVLXVKSMIYKIIKHSKVFKKKLHIKXSDAXTPXLGDVRXXXLGLPGRAPPLYRAK

SEQ ID NO: 1245 - protein, 227 aa, Homo sapiens
  misc_feature (198)..(198): Xaa can be any naturally occurring amino acid
  misc_feature (204)..(204): Xaa can be any naturally occurring amino acid
  misc_feature (221)..(221): Xaa can be any naturally occurring amino acid
  misc_feature (224)..(224): Xaa can be any naturally occurring amino acid
GDPVGREEGGKMVLESTMVCVDNSEYMRNGDFLPTRLQAQQDAVNIVCHSKTRSNPENNVGLITLANDCEVLTTLTPDTGRILSKLHTVQPKGKITFCTGIRVAHLALKHRQGKNHKMRIIAFVGSPVEDNEKDLVKLAKRLKKEKVNVDIINFGEEEVNTEKLTAFVNTLNGKDGTGSYLVTVPSGPSLADALISSXILAGEXGALAGSWVPVTFEFWSXIPXLDP

SEQ ID NO: 1246 - protein, 141 aa, Homo sapiens
QNTAKVNCVGEPHLHRNQINEFRGYDYSNLRAHQKQASRSQFASVCLSGDKWENMVPPVRDPLSCAAHSTTSLCCFHQAETLPYGVYGLLPVHQCDRKDSCHYCPWLQFKGIQCRCKFYGTIFIGGFGQNAVVVQLINTNC

SEQ ID NO: 1247 - protein, 106 aa, Homo sapiens
GPTRSRPRGVNLPLCASVETSGKTWSHLCETPCPVLLTQQHLCVAFTRLRPYPMGYMGFYLCTSVTGKIHVTTVRGYNSKVSNVAVNFMALFLLEDLVRMQLLYNS

SEQ ID NO: 1248 - protein, 194 aa, Homo sapiens
PKEEDMEVDIPAVKVKEEPRDEEEEAKMKAPPKAARKTPGLPKDVSVAELLRELSLTKEEELLFLQLPDTLPGQPPTQDIKPIKTEVQGEDGQVVLIKQEKDREAKLAENACTLADLTEGQVGKLLIRKSGRVQLLLGKVTLDVTMGTACSFLQELVSVGLGDSRTGEMTVLGHVKHKLVCSPDFESLLDHKHR

SEQ ID NO: 1249 - protein, 106 aa, Homo sapiens
  misc_feature (53)..(53): Xaa can be any naturally occurring amino acid
  misc_feature (61)..(61): Xaa can be any naturally occurring amino acid
  misc_feature (65)..(65): Xaa can be any naturally occurring amino acid
  misc_feature (73)..(73): Xaa can be any naturally occurring amino acid
  misc_feature (78)..(78): Xaa can be any naturally occurring amino acid
  misc_feature (83)..(83): Xaa can be any naturally occurring amino acid
  misc_feature (88)..(88): Xaa can be any naturally occurring amino acid
  misc_feature (91)..(91): Xaa can be any naturally occurring amino acid
  misc_feature (96)..(96): Xaa can be any naturally occurring amino acid
  misc_feature (98)..(98): Xaa can be any naturally occurring amino acid
QGQVPSSKDVPSPRCRKVTVPFTAAVGGNPGGPGTMVAKGWNEWAQMGPLLGXQNSRTKCXGQGXNPGAQGAXLPSPXYFYRXFGIPXGIXKSRGXYXFVAYVFPR

SEQ ID NO: 1250 - protein, 113 aa, Homo sapiens
  misc_feature (61)..(61): Xaa can be any naturally occurring amino acid
  misc_feature (68)..(68): Xaa can be any naturally occurring amino acid
  misc_feature (73)..(73): Xaa can be any naturally occurring amino acid
  misc_feature (81)..(81): Xaa can be any naturally occurring amino acid
  misc_feature (86)..(86): Xaa can be any naturally occurring amino acid
  misc_feature (90)..(90): Xaa can be any naturally occurring amino acid
  misc_feature (96)..(96): Xaa can be any naturally occurring amino acid
  misc_feature (98)..(98): Xaa can be any naturally occurring amino acid
  misc_feature (104)..(104): Xaa can be any naturally occurring amino acid
  misc_feature (106)..(106): Xaa can be any naturally occurring amino acid
DINTKINSRAKSPAARMCHLHAAGRSLCHSQLLWEETLGDLEQWLPKAGMSGLKWGPFWGXKIQEQNXLDKAXTRGPKAPXFLHLXIFTXGLGSQXGXKNQGEXTXLWLTFSQ

SEQ ID NO: 1251 - protein, 114 aa, Homo sapiens [sequence omitted]

SEQ ID NO: 1252 - protein, 126 aa, Homo sapiens
  misc_feature (34)..(34): Xaa can be any naturally occurring amino acid
  misc_feature (46)..(46): Xaa can be any naturally occurring amino acid
  misc_feature (104)..(104): Xaa can be any naturally occurring amino acid
  misc_feature (109)..(109): Xaa can be any naturally occurring amino acid
  misc_feature (115)..(115): Xaa can be any naturally occurring amino acid
  misc_feature (117)..(120): Xaa can be any naturally occurring amino acid
  misc_feature (124)..(124): Xaa can be any naturally occurring amino acid
SERSSMSVGLGRSQLDSKGGVVGGTIDVNALEMXAHISEHPNQQPXHKIQITMGSTEARVDYMGSSILMGIFSNADLKLQDEWKVNLYNTLDSSITDKSEIFVXWRFEXGIFFQXNXXXXQPHXIW

SEQ ID NO: 1253 - protein, 87 aa, Homo sapiens
  misc_feature (19)..(19): Xaa can be any naturally occurring amino acid
  misc_feature (31)..(32): Xaa can be any naturally occurring amino acid
  misc_feature (41)..(41): Xaa can be any naturally occurring amino acid
  misc_feature (45)..(45): Xaa can be any naturally occurring amino acid
  misc_feature (47)..(51): Xaa can be any naturally occurring amino acid
  misc_feature (57)..(57): Xaa can be any naturally occurring amino acid
  misc_feature (61)..(61): Xaa can be any naturally occurring amino acid
KSLFFGGRLRNWSPRKTEXVCWIKLLCEKIXXASFLFFTRXGVVXLXXXXXGKISHXQISXGRKSHFYQLCLNPMYYTSLLSIHPEA

SEQ ID NO: 1254 - protein, 50 aa, Homo sapiens
KQLNVQMNMSNVMGNTTWTTSGLKSQGRLSVGSNRDPRDQACLLVWEDHN

SEQ ID NO: 1255 - protein, 220 aa, Homo sapiens
  misc_feature (182)..(182): Xaa can be any naturally occurring amino acid
  misc_feature (191)..(191): Xaa can be any naturally occurring amino acid
  misc_feature (203)..(203): Xaa can be any naturally occurring amino acid
EAGTTPAKDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRREVKQQEEEPQVDVWELLKNAKPSEYEKIAXQYGITDLRXMLKRLKRMPQRXEKRPHFCQKILGSCLSG

SEQ ID NO: 1256 - protein, 139 aa, Homo sapiens
  misc_feature (111)..(111): Xaa can be any naturally occurring amino acid
  misc_feature (118)..(118): Xaa can be any naturally occurring amino acid
  misc_feature (128)..(128): Xaa can be any naturally occurring amino acid
IYKIPVMKTFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKGGLSXCRLLLQXVPPNIIDSYXRDLHSSNPEEY

SEQ ID NO: 1257 - protein, 210 aa, Homo sapiens
CLSLPSSWDHRQLYLSMNIDDKLEGLFLKCGGIDEMQSSRTMVVMGGVSGQSTVSGELQDSVLQDRSMPHQEILAADEVLQESEMRQQDMISHDELMVHEETVKNDEEQMETHERLPQGLQYALNVPISVKQEITFTDVSEQLMRDKKQIREPVDLQKKKKRKQRSPAKILTINEDGSLGLKTPKSHVCEHCNAAFRTNYPYRDMSSSYR

SEQ ID NO: 1258 - protein, 198 aa, Homo sapiens
SFSDSDDDSCLWKRKRQKCFNPPPKPEPFQFGQSSQKPPVAGGKKINNIWGAVLQEQNQDAVATELGILGMEGTIDRSRQSETYNYLLAKKLRKESQEHTKDLDKELDEYMHGGKKMGSKEEENGQGHLKRKRPVKDRLGNRPEMNYKGRYQITAEDSQEKVADEISFRLQEPKKDLIAPSSEDYWYKKAIELLMETR

SEQ ID NO: 1259 - protein, 103 aa, Homo sapiens
  misc_feature (50)..(50): Xaa can be any naturally occurring amino acid
  misc_feature (56)..(56): Xaa can be any naturally occurring amino acid
RQSLALSPRLEYSGTISAHCNLCLPGSGDSPASASRVAGIIGMENHTWLXFVFLVXMKFHHVGLAGLKLLTSSDLPALVSQSVGITGVSHRAWPMLVFILKIA

SEQ ID NO: 1260 - protein, 98 aa, Homo sapiens
  misc_feature (53)..(53): Xaa can be any naturally occurring amino acid
  misc_feature (77)..(77): Xaa can be any naturally occurring amino acid
FTAKINLKKQTNLQMVCYDLDKTDYQLVILIISTCNKIEKLNPVLYTLKVFLXKYIFKMFYQLHFFPHIFLNQEKQXGLFLQEFSWFIQVAKTLAISS

SEQ ID NO: 1261 - protein, 266 aa, Homo sapiens
ELARLQVDTSGSKAAFEPAIDMQKSVPNKALELKNEQTLRADEILPSESKQKDYEESSWDSESLCETVSQKDVCLPKAAHQKEIDKINGKLEGSPVKDGLLKANCGMKVSIPTKALELMDMQTFKAEPPEKPSAFEPAIEMQKSVPNKALELKNEQTLRADEILPSESKQKDYEESSWDSESLCETVSQKDVCLPKAAHQKEIDKINGKLEGSPVKDGLLKANCGMKVSIPTKALELMDMQTFKAEPPEKPSAFEPAIEMQKVCSK

SEQ ID NO: 1262 - protein, 335 aa, Homo sapiens
  misc_feature (207)..(207): Xaa can be any naturally occurring amino acid
  misc_feature (214)..(214): Xaa can be any naturally occurring amino acid
  misc_feature (259)..(259): Xaa can be any naturally occurring amino acid
KELEVKQQLEQALRIQDIELKSVESNLNQVSHTHENENYLLHENCMLKKEIAMLKLEIATLKHQYQEKENKYFEDIKILKEKNAELQMTLKLKEESLTKRASQYSGQLKVLIAENTMLTSKLKEKQDKEILEAEIESHHPRLASAVQDHDQIVTSRKSQEPAFHIAGDACLQRKMNVDVSSTIYNNEVLHQPLFEAQRKSKSLKINXNYAGDAXRENTLVSEHAQRDQRETQCQMKEAEHMYQNEQDNVNKHTEQQESXDQKLFQLQSKNMWLQQQLVHAHKKADNKSKITIDIHFLERKMQHHLLKEKNEEIFNYNNHLKNRIYQYEKRKQKQK

SEQ ID NO: 1263 - protein, 225 aa, Homo sapiens
  misc_feature (183)..(183): Xaa can be any naturally occurring amino acid
  misc_feature (205)..(205): Xaa can be any naturally occurring amino acid
  misc_feature (210)..(210): Xaa can be any naturally occurring amino acid
  misc_feature (221)..(221): Xaa can be any naturally occurring amino acid
AEPPEKPSAFEPAIEMQKSVPNKALELKNEQTLRADEILPSESKQKDYEESSWDSESLCETVSQKDVCLPKAAHQKEIDKINGKLEGSPVKDGLLKANCGMKVSIPTKALELMDMQTFKAEPPEKPICFEPAIEMQKSVPNKALELKNEQTLRADEILPSESKQKDYEESSWDSESLCETVSXRMCVSQGCASKRNRLNNGKLEXLLLRXLLKLTADESSXPLKP

SEQ ID NO: 1264 - protein, 153 aa, Homo sapiens
  misc_feature (63)..(63): Xaa can be any naturally occurring amino acid
  misc_feature (115)..(115): Xaa can be any naturally occurring amino acid
  misc_feature (121)..(121): Xaa can be any naturally occurring amino acid
  misc_feature (123)..(123): Xaa can be any naturally occurring amino acid
  misc_feature (133)..(133): Xaa can be any naturally occurring amino acid
RQSLTLSLRLECSSGISAHLPLGFKPFSCLSLPSSWDYRGVHHHDHLIFSCLFCFFGFCFFLXWSLSLSPRLECSSGISAHLPPGFKPFSCLSLPSSWDYRGVHHHAHLIFSCFXFLVLFXTXSCSVAQAGVXWRDLSSLQAPPPRFTPFCYE

SEQ ID NO: 1265 - protein, 223 aa, Homo sapiens
  misc_feature (222)..(222): Xaa can be any naturally occurring amino acid
ILPSESKQKDYEESSWDSESLCETVSQKDVCLPKAAHQKEIDKINGKLEGSPVKDGLLKANCGMKVSIPTKALELMDMQTFKAEPPEKPSAFEPAIEMQKSVPNKALELKNEQTLRADEILPSESKQKDYEESSWDSESLCETVSQKDVCLPKAAHQKEIDKINGKLEGSPVKDGLLKANCGMKVSIPTKALELMDMQTFKAEPPEKPSAFEPAIEMQKVCXK

SEQ ID NO: 1266 - protein, 91 aa, Homo sapiens
SFCLDSDGSISSALNVCSFFNSKALFGTDFCISMAGSKADGFSGGSALKVCMSINSKALVGIETFIPQLAFRRPSLTGDPSNFPFILSISF

SEQ ID NO: 1267 - protein, 171 aa, Homo sapiens
NEQTLRADEILPSESKQKDYEESSWDSESLCETVSQKDVCLPKATHQKEIDKINGKLEESPDNDGFLKAPCRMKVSIPTKALELMDMQTFKAEPPEKPSAFEPAIEMQKSVPNKALELKNEQTLRADQMFPSESKQKKVEENSWDSESLRETVSQKDVCVPRLHIKKKWIK

SEQ ID NO: 1268 - protein, 169 aa, Homo sapiens
QKDYEESSWDSESLCETVSQKDVCLPKAAHQKEIDKINGKLEGSPVKDGLLKANCGMKVSIPTKALELMDMQTFKAEPPEKPSAFEPAIEMQKSVPNKALELKNEQTLRADEILPSESKQKDYEESSWDSESLCETVSQKDVCLPKAAHQKEIDKINGKLEGSPVKDGF

SEQ ID NO: 1269 - protein, 196 aa, Homo sapiens
  misc_feature (7)..(7): Xaa can be any naturally occurring amino acid
  misc_feature (63)..(63): Xaa can be any naturally occurring amino acid
  misc_feature (83)..(83): Xaa can be any naturally occurring amino acid
  misc_feature (127)..(128): Xaa can be any naturally occurring amino acid
RQKLNHXHPRLASAGQAHDQIVTSRKSQEPAFHIAGDACLQRKMNVDVSSTIYNNEVLHQPLXEAQRKSKSLKINLNYAGDAXRENTLVSEHAQRDQRETQCQMKEAEHMYQNEQDNVNKHTEQQEXXDQKLFQLQSKNMWLQQQLVHAHKKADNKSKITIDIHFLERKMQHHLLKEKNEEIFNYNNHLKNRIYQY

SEQ ID NO: 1270 - protein, 106 aa, Homo sapiens
  misc_feature (56)..(56): Xaa can be any naturally occurring amino acid
  misc_feature (101)..(101): Xaa can be any naturally occurring amino acid
ISPHFSLLGDDVAFSSQENEYQLLSCFCCQLSYVHELIAVEATYFCFVVEIISDLXTPAVQCVCSHYLVRFDTCVQLPSFDTVFHVGLFVHVLKPMYFLLXHLRHN

SEQ ID NO: 1271 - protein, 168 aa, Homo sapiens
  misc_feature (155)..(155): Xaa can be any naturally occurring amino acid
NEQTLRADEILPSESKQKDYEESSWDSESLCETVSQKDVCLPKAAHQKEIDKINGKLEGSPVKDGLLKANCGMKVSIPTKALELMDMQTFKAEPPEKPSAFEPAIEMQKSVPNKALELKNEQTLRADEILPSESKQKDYEESSWDSESLCETVSXKDVCFPRLRIKKK

SEQ ID NO: 1272 - protein, 91 aa, Homo sapiens; identical to SEQ ID NO: 1266

SEQ ID NO: 1273 - protein, 177 aa, Homo sapiens
  misc_feature (15)..(15): Xaa can be any naturally occurring amino acid
  misc_feature (44)..(45): Xaa can be any naturally occurring amino acid
  misc_feature (64)..(64): Xaa can be any naturally occurring amino acid
  misc_feature (81)..(81): Xaa can be any naturally occurring amino acid
  misc_feature (90)..(90): Xaa can be any naturally occurring amino acid
  misc_feature (109)..(109): Xaa can be any naturally occurring amino acid
  misc_feature (155)..(155): Xaa can be any naturally occurring amino acid
SNWTSRKSQEPAFHXAGDACLQRKMNVDVSSTIYNNEVLHQPLXXAQRKSKSLKINLNYAGDAXRENTLVSEHAQRDQREXQCQMKEAEXMYQNEQDNVNKHTEQQESXDQKLFQLQSKNMWLQQQLVHAHKKADNKSKITIDIHFLERKMQHHXLKEKNEEIFNYNNHLKNRIYQY

SEQ ID NO: 1274 - protein, 106 aa, Homo sapiens
  misc_feature (10)..(10): Xaa can be any naturally occurring amino acid
  misc_feature (56)..(56): Xaa can be any naturally occurring amino acid
  misc_feature (74)..(74): Xaa can be any naturally occurring amino acid
  misc_feature (83)..(83): Xaa can be any naturally occurring amino acid
  misc_feature (101)..(101): Xaa can be any naturally occurring amino acid
ISPHFSLLGXDVAFSSQENEYQLLSCFCCQLSYVHELIAVEATYFCFVVEIISDLXTPAVQCVCSHYLVRFDTXVQLPSFDTXFHVGLFVHVLKPMYFLLXHLRHN

SEQ ID NO: 1275 - protein, 181 aa, Homo sapiens
EILEAEIESHHPRLASAVQDHDQIVTSRKSQEPAFHIAGDACLQRKMNVDVSSTIYNNEVLHQPLSEAQRKSKSLKINLNYAGDALRENTLVSEHAQRDQRETQCQMKEAEHMYQNEQDNVNKHTEQQESLDQKLFQLQSKNMWLQQQLVHAHKKADNKSKIQLIFIFLRGKCNISPKREK

SEQ ID NO: 1276 - protein, 57 aa, Homo sapiens
  misc_feature (4)..(4): Xaa can be any naturally occurring amino acid
  misc_feature (9)..(9): Xaa can be any naturally occurring amino acid
  misc_feature (19)..(19): Xaa can be any naturally occurring amino acid
  misc_feature (26)..(26): Xaa can be any naturally occurring amino acid
SFCXPQAVXPFSVFVHLSXIHSDLVXTFSIFIKLSLTVLTLIALMLQDVFSSWCRTI

SEQ ID NO: 1277 - protein, 146 aa, Homo sapiens
  misc_feature (7)..(7): Xaa can be any naturally occurring amino acid
  misc_feature (27)..(27): Xaa can be any naturally occurring amino acid
  misc_feature (47)..(47): Xaa can be any naturally occurring amino acid
  misc_feature (68)..(68): Xaa can be any naturally occurring amino acid
  misc_feature (94)..(94): Xaa can be any naturally occurring amino acid
FFEAQKXIPKSLKIIFNYAGDGFKRKXMGFRTCTKSQRETQCQMKEXEHMFQNEQDNVNKHIEQQESXDQKLFQLQSKNMWLQQQLVHAHKKAXNKSKITIDIHFLERKMQHHLLKEKNEEIFNYNNHLKNRIYQYEKEKAETENS

SEQ ID NO: 1278 - protein, 184 aa, Homo sapiens
KELEVKQQLEQALRIQDIELKSVESNLNQVSHTHENENYLLHENCMLKKEIAMLKLEIATLKHQYQEKENKYFEDIKILKEKNAELQMTLKLKEESLTKRASQYSGQLKVLIAENTMLTSKLKEKQDKEILEAEIESHHPRLASAVQDHDQIVTSRKSQEPAFHIAGDACLQRKMNVDVSSTDI

SEQ ID NO: 1279 - protein, 220 aa, Homo sapiens
  misc_feature (182)..(182): Xaa can be any naturally occurring amino acid
  misc_feature (185)..(185): Xaa can be any naturally occurring amino acid
  misc_feature (198)..(198): Xaa can be any naturally occurring amino acid
AFEPAIDMQKSVPNKALELKNEQTLRADEILPSESKQKDYEESSWDSESLCETVSQKDVCLPKAAHQKEIDKINGKLEGSPVKDGLLKANCGMKVSIPTKALELMDMQTFKAEPPEKPSAFEPAIEMQKSVPNKALELKNEQTLRADEILPSESKQKDYEESSWDSESLCETVSRRMCVYPXLAXQKEIDKINGKLEXRYAAEFKTFFAMIRASVKEGLL

SEQ ID NO: 1280 - protein, 195 aa, Homo sapiens
  misc_feature (142)..(142): Xaa can be any naturally occurring amino acid
  misc_feature (144)..(144): Xaa can be any naturally occurring amino acid
  misc_feature (185)..(185): Xaa can be any naturally occurring amino acid
LCETVSQKDVCLPKAAHQKEIDKINGKLEGSPVKDGLLKANCGMKVSIPTKALELMDMQTFKAEPPEKPSAFEPAIEMQKSVPNKALELKNEQTLRADEILPSESKQKDYEESSWDSESLCETVSQKDVCLPKAAHQKEIDXIXGKLEGSPVKDGLLKANCGMKVSISTKALRIDGHANFQSRAXREAICLRACH

SEQ ID NO: 1281 - protein, 209 aa, Homo sapiens
  misc_feature (199)..(199): Xaa can be any naturally occurring amino acid
NLNQVSHTHENENYLLHENCMLKKEIAMLKLEIATLKHQYQEKENKYFEDIKILKEKNAELQMTLKLKEESLTKRASQYSGQLKVLIAENTMLTSKLKEKQDKEILEAEIESHHPRLASAVQDHDQIVTSRKSQEPAFHIAGDACLQRKMNVDVSSTIYNNEVLHQPLSEAQRKSKSLKINLNYAGDALRENHWFQNMXKETNVKHSVK

SEQ ID NO: 1282 - protein, 120 aa, Homo sapiens
SYNFAAKNSAVVPQGFMIKSKLLGVVYRVLRIWTFLLLHVFTGLFFGLEHFSQVLGLLPQFLSLSPFCPTPWLGLSLPLTPPCRYLSQSLSHRIICFFTCLFLPLNHEVFEGRVRGLVIF

SEQ ID NO: 1283 - protein, 81 aa, Homo sapiens
KITKPLTRPSKTSWFKGRNRQVKKQIILCDRDCDKYLQGGVSGRLNPSQGVGQKGERERNWGRSPNTWEKCSKPKNSPVNT

SEQ ID NO: 1284 - protein, 181 aa, Homo sapiens
  misc_feature (61)..(61): Xaa can be any naturally occurring amino acid
  misc_feature (68)..(68): Xaa can be any naturally occurring amino acid
  misc_feature (113)..(113): Xaa can be any naturally occurring amino acid
QDHDQIVTSRKSQEPAFHIAGDACLQRKMNVDVSSTIYNNEVLHQPLFEAQRKSKSLKINXNYAGDAXRENTLVSEHAQRDQRETQCQMKEAEHMYQNEQDNVNKHTEQQESXDQKLFQLQSKNMWLQQQLVHAHKKADNKSKITIDIHFLERKMQHHLLKEKNEEIFNYNNHLKNRIYQY

SEQ ID NO: 1285 - protein, 106 aa, Homo sapiens; identical to SEQ ID NO: 1270
  misc_feature (56)..(56): Xaa can be any naturally occurring amino acid
  misc_feature (101)..(101): Xaa can be any naturally occurring amino acid

SEQ ID NO: 1286 - protein, 105 aa, Homo sapiens
SFCLDSDGSISSALNVCSFFNSKALFGTDFCISMAGSKADGFSGGSALKVCMSINSKALVGIETFIPQLAFRRPSLTGDLIIAENVLNSAAYLPSNFPFILSISF

SEQ ID NO: 1287 - protein, 229 aa, Homo sapiens
CVSLKPPEKPSAFEPAIEMQKSVPNKALELKNEQTLRADEILPSESKQKDYEESSWDSESLCETVSQKDVCLPKAAHQKEIDKINGKLEGRYAAEFRTFSAMIRSPVKDGLLKANCGMKVSIPTKALELMDMQTFKAEPPEKPSAFEPAIEMQKSVPNKALELKNEQTLRADEILPSESKQKDYEESSWDSESLCETVSQKDVCLPKAAHQKEIDKINGKLEAIRDGST

SEQ ID NO: 1288 - protein, 174 aa, Homo sapiens
  misc_feature (149)..(149): Xaa can be any naturally occurring amino acid
  misc_feature (157)..(157): Xaa can be any naturally occurring amino acid
  misc_feature (170)..(170): Xaa can be any naturally occurring amino acid
CVSLKPPEKPSAFEPAIEMQKSVPNKALELKNEQTLRADEILPSESKQKDYEESSWDSESLCETVSQKDVCLPKAAHQKEIDKINGKLEGRYAAEFRTFSAMIRSPVKDGLLKANCGMKVSIPTKALELMDMQTFKAEPPEKPSAFEPXIGKPKVCXQIKAFGIGRMDQXLGAR

SEQ ID NO: 1289 - protein, 108 aa, Homo sapiens
  misc_feature (5)..(5): Xaa can be any naturally occurring amino acid
  misc_feature (9)..(9): Xaa can be any naturally occurring amino acid
  misc_feature (16)..(16): Xaa can be any naturally occurring amino acid
  misc_feature (30)..(30): Xaa can be any naturally occurring amino acid
  misc_feature (38)..(38): Xaa can be any naturally occurring amino acid
PFGWXSEGXYSHRAPXGWSILPIPKAFIWXQTFGFPMXGSKADGFSGGSALKVCMSINSKALVGIETFIPQLAFRRPSLTGDLIIAENVLNSAAYLPSNFPFILSISF

SEQ ID NO: 1290 - protein, 117 aa, Homo sapiens
IQQHIYLLIFHLFYLFLFDAQPWVNTHPSVKQSHRDSQNPKNFLHSPFVWILMGVSHLLSMFVHSSIPRLYLEQTFAFQWQARRQMASREALMKHIRITYIIPFILFFNIAYLWKGT

SEQ ID NO: 1291 - protein, 189 aa, Homo sapiens
ILPSESKQKDYEESSWDSESLCETVSQKDVCLPKAAHQKEIDKINGKLEGRYAAEFRTFSAMIRSPVKDGLLKANCGMKVSIPTKALELMDMQTFKAEPPEKPSAFEPAIEMQKSVPNKALELKNEQTLRADEILPSESKQKDYEESSWDSESLCETVSQKDVCLPKAAHQKEIDKINGKLEAIRDGST

SEQ ID NO: 1292 - protein, 105 aa, Homo sapiens; identical to SEQ ID NO: 1286

SEQ ID NO: 1293 - protein, 181 aa, Homo sapiens
  misc_feature (2)..(2): Xaa can be any naturally occurring amino acid
  misc_feature (61)..(61): Xaa can be any naturally occurring amino acid
  misc_feature (85)..(85): Xaa can be any naturally occurring amino acid
QXHDQIVTSRKSQEPAFHIAGDACLQRKMNVDVSSTIYNNEVLHQPLSEAQRKSKSLKINXNYAGDALRENTLVSEHAQRDQREXQCQMKEAEHMYQNEQDNVNKHTEQQESLDQKLFQLQSKNMWLQQQLVHAHKKADNKSKITIDIHFLERKMQHHLLKEKNEEIFNYNNHLKNRIYQY

SEQ ID NO: 1294 - protein, 106 aa, Homo sapiens
  misc_feature (83)..(83): Xaa can be any naturally occurring amino acid
ISPHFSLLGDDVAFSSQENEYQLLSCFCCQLSYVHELIAVEATYFCFVVEIISDLETPAVQCVCSHYLVRFDTCVQLPSFDTXFHVGLFVHVLKPMYFLLEHLRHN

SEQ ID NO: 1295 - protein, 185 aa, Homo sapiens
  misc_feature (176)..(176): Xaa can be any naturally occurring amino acid
YGRFLLLIVGYFCFSYCHLKYIFNVEILTACLMKSSFQIFLGSPVKDGLLKANCGMKVSIPTKALELMDMQTFKAEPPEKPSAFEPAIEMQKSVPNKALELKNEQTLRADEILPSESKQKDYEESSWDSESLCETVSQKDVCLPKAAHQKEIDKINGKLEGRYAAEFRTFSAMIRXPVKRWSSEG

SEQ ID NO: 1296 - protein, 130 aa, Homo sapiens
  misc_feature (1)..(1): Xaa can be any naturally occurring amino acid
  misc_feature (9)..(9): Xaa can be any naturally occurring amino acid
  misc_feature (15)..(15): Xaa can be any naturally occurring amino acid
  misc_feature (54)..(54): Xaa can be any naturally occurring amino acid
  misc_feature (58)..(58): Xaa can be any naturally occurring amino acid
  misc_feature (72)..(72): Xaa can be any naturally occurring amino acid
  misc_feature (80)..(80): Xaa can be any naturally occurring amino acid
  misc_feature (84)..(84): Xaa can be any naturally occurring amino acid
  misc_feature (96)..(96): Xaa can be any naturally occurring amino acid
  misc_feature (100)..(100): Xaa can be any naturally occurring amino acid
  misc_feature (102)..(102): Xaa can be any naturally occurring amino acid
  misc_feature (106)..(106): Xaa can be any naturally occurring amino acid
  misc_feature (110)..(110): Xaa can be any naturally occurring amino acid
  misc_feature (116)..(116): Xaa can be any naturally occurring amino acid
XIIFIFMSXRNLTLXSSCSHLTFWFSNWDFISFASDSFFFSTQNFFFICSIFPXVVHXDLFEVPLLFHKNEXYPKFLIGXLNLXIFHLFYPFLFDXNLGXTXHPSXEQVXTEDLSXNPKNFLQPFFCFDS

SEQ ID NO: 1297 - protein, 103 aa, Homo sapiens
  misc_feature (6)..(6): Xaa can be any naturally occurring amino acid
  misc_feature (12)..(12): Xaa can be any naturally occurring amino acid
  misc_feature (20)..(20): Xaa can be any naturally occurring amino acid
  misc_feature (40)..(40): Xaa can be any naturally occurring amino acid
  misc_feature (43)..(43): Xaa can be any naturally occurring amino acid
  misc_feature (91)..(91): Xaa can be any naturally occurring amino acid
  misc_feature (96)..(96): Xaa can be any naturally occurring amino acid
  misc_feature (100)..(100): Xaa can be any naturally occurring amino acid
MGTRAXQCEVSXTHENENYXLHENCMLKKEIAMLKLEIAXLKXQYQEKENKYFEDIKILKEKNAELQMTLKLKEESLTKRASQYSGQLKVXIAENXMLTXKLK

SEQ ID NO: 1298 - protein, 98 aa, Homo sapiens
  misc_feature (1)..(4): Xaa can be any naturally occurring amino acid
  misc_feature (7)..(8): Xaa can be any naturally occurring amino acid
  misc_feature (11)..(12): Xaa can be any naturally occurring amino acid
  misc_feature (14)..(14): Xaa can be any naturally occurring amino acid
  misc_feature (30)..(31): Xaa can be any naturally occurring amino acid
  misc_feature (36)..(36): Xaa can be any naturally occurring amino acid
  misc_feature (40)..(40): Xaa can be any naturally occurring amino acid
  misc_feature (44)..(44): Xaa can be any naturally occurring amino acid
  misc_feature (46)..(46): Xaa can be any naturally occurring amino acid
  misc_feature (50)..(50): Xaa can be any naturally occurring amino acid
  misc_feature (62)..(62): Xaa can be any naturally occurring amino acid
  misc_feature (66)..(66): Xaa can be any naturally occurring amino acid
  misc_feature (74)..(74): Xaa can be any naturally occurring amino acid
  misc_feature (88)..(88): Xaa can be any naturally occurring amino acid
  misc_feature (92)..(92): Xaa can be any naturally occurring amino acid
XXXXTIXXRFXXFXFKNQNKRRVEENFWGXXKGPRXRLVXKKDXGXPQGXHQKEMDKISGKXEDSXSLSKILDXVHSCERARELQKDXCEQXQEKWNK

SEQ ID NO: 1299 - protein, 207 aa, Homo sapiens
  misc_feature (200)..(200): Xaa can be any naturally occurring amino acid
  misc_feature (202)..(202): Xaa can be any naturally occurring amino acid
KPSAFEPAIEMQKSVPNKALELKNEQTLRADEILPSESKQKDYEESSWDSESLCETVSQKDVCLPKAAHQKEIDKINGKLEGRYAAEFGTFSAMIRSPVKDGLLKANCGMKVSIPTKALELMDMQTFKAEPPEKPSAFEPAIEMQKSVPNKALELKNEQTLRADEISHQNPNKRTMKKVLGILRVSVRLFHRKDVCLPQXAXQKEID

SEQ ID NO: 1300 - protein, 187 aa, Homo sapiens
  misc_feature (6)..(6): Xaa can be any naturally occurring amino acid
  misc_feature (119)..(119): Xaa can be any naturally occurring amino acid
TGFCWXKAHDQIVTSRKSQEPAFHIAGDACLQRKMNVDVSSPIYNNEVLHQPLSEAQRKSKSLKINLNYAGDALRENTLVSEHAQRDQRETQCQMKEAEHMYQNEQDNVNKHTEQQESXDQKLFQLQSKNMWLQQQLVHAHKKADNKSKITIDIHFLERKMQHHLLKEKNEEIFNYNNHLKNRIYQY

SEQ ID NO: 1301 - protein, 164 aa, Homo sapiens
PAIEMQKSVPNKALELKNEQTLRADQMFPSESKQKKVEENSWDSESLRETVSQKDVCVPKATHQKEMDKISGKLEDSTSLSKILDTVHSCERARELQKDHCEQRTGKMEQMKKKFCVLKKKLSEAKEIKSQLENQKVKWEQELCSVRVLTLMKMKIISYMKIAC

SEQ ID NO: 1302 - protein, 196 aa, Homo sapiens
  misc_feature (20)..(20): Xaa can be any naturally occurring amino acid
DLKTVKEKDDILFEDLQDNXNENGEGEIEDEEEEGYDDDDDDWDWDEGVGKLAKGYVWNGGSNPQANRQTSDSSSAKMSTPADKVLRKFENKINLDKLNVTDSVINKVTEKSRQKEADMYRIKDKADRATVEQVLDPRTRMILFKMLTRGIITEINGCISTGKEANVSMLAQQMERAEQSKFIKLLFWCSKIGINM

SEQ ID NO: 1303 - protein, 205 aa, Homo sapiens [sequence omitted]

SEQ ID NO: 1304 - protein, 164 aa, Homo sapiens; identical to SEQ ID NO: 1301

SEQ ID NO: 1305 - protein, 133 aa, Homo sapiens
ETVSQKDVCVPKATHQKEMDKISGKLEDSTSLSKILDTVHSCERARELQKDHCEQRTGKMEQMKKKFCVLKKKLSEAKEIKSQLENQKVKWEQELCSVRLTLNPEEEKRRNADILNEKIREELGRIEEHIGKS

SEQ ID NO: 1306 - protein, 83 aa, Homo sapiens
  misc_feature (8)..(8): Xaa can be any naturally occurring amino acid
  misc_feature (11)..(11): Xaa can be any naturally occurring amino acid
  misc_feature (13)..(15): Xaa can be any naturally occurring amino acid
  misc_feature (21)..(21): Xaa can be any naturally occurring amino acid
  misc_feature (31)..(31): Xaa can be any naturally occurring amino acid
  misc_feature (47)..(47): Xaa can be any naturally occurring amino acid
  misc_feature (54)..(54): Xaa can be any naturally occurring amino acid
QRFISLFXDGXSXXXISSLSXQFPFSTCNFXEEIIFIFMSVRTLIQXTFYTLQXYILYSESLFKCCFTSNSFLCALRFFLILP

SEQ ID NO: 1307 - protein, 231 aa, Homo sapiens
  misc_feature (15)..(16): Xaa can be any naturally occurring amino acid
  misc_feature (30)..(30): Xaa can be any naturally occurring amino acid
  misc_feature (33)..(33): Xaa can be any naturally occurring amino acid
  misc_feature (36)..(36): Xaa can be any naturally occurring amino acid
  misc_feature (136)..(136): Xaa can be any naturally occurring amino acid
  misc_feature (164)..(164): Xaa can be any naturally occurring amino acid
  misc_feature (227)..(227): Xaa can be any naturally occurring amino acid
LKRGISNKVGQLKVXXSLRTQCSLFKLKEXQAXEIXEAEIESHHPRLASAVQDHDQIVTSRKSQEPAFHIAGDACLQRKMNVDVSSTIYNNEVLHQPLSEAQRKSKSLKINLNYAGDALRENTLVSEHAQRDQREXQCQMKEAEHMYQNEQDNVNKHTEQQESXDQKLFQLQSKNMWLQQQLVHAHKKADNKSKITIDIHFLERKMQHHLLKEKNEEIFNYNNHLKXRIYQ

SEQ ID NO: 1308 - protein, 183 aa, Homo sapiens
  misc_feature (20)..(20): Xaa can be any naturally occurring amino acid
  misc_feature (171)..(171): Xaa can be any naturally occurring amino acid
DLKTVKEKDDILFEDLQDNXNENGEGEIEDEEEEGYDDDDDDWDWDEGVGKLAKGYVWNGGSNPQANRQTSDSSSAKMSTPADKVLRKFENKINLDKLNVTDSVINKVTEKSRQKEADMYRIKDKADRATVEQVLDPRTRMILFKMLTRGIITEINGCISTGKEANVSMLXTANGESRAIKIY

SEQ ID NO: 1309 - protein, 219 aa, Homo sapiens
EECIRMPDFVHADLSEFNMLYHGGGVYIIDVSQSVEHDHPHALEFLRKDCANVNDFFMRHSVAVMTVRELFEFVTDPSITHENMDAYLSKAMEIASQRTKEERSSQDHVDEEVFKRAYIPRTLNEVKNYERDMDIIMKLKEEDMAMNAQQDNILYQTVTGLKKDLSGVQKVPALLENQVEERTCSDSEDIGSSECSDTDSEEQGDHARPKKHTTDPDID

SEQ ID NO: 1310 - protein, 191 aa, Homo sapiens
  misc_feature (136)..(136): Xaa can be any naturally occurring amino acid
  misc_feature (186)..(186): Xaa can be any naturally occurring amino acid
EPDQKPEPVDKVAAMREFRVLHTALHSSSSYREAVFKMLSNKESLDQIIVATPGLSSDPIALGVLQDKDLFSVFADPNMLDTLVPAHPALVNAIVLVLHSVAGSAPMPGTDSSSRSMPSSSYRDMPGGFLFEGLSXDEDDFHPNTRSTPSSSTPSSRQPPGVQVELLGPGPSPKVSWPPPWPWPAXRRASF

SEQ ID NO: 1311 - protein, 164 aa, Homo sapiens
  misc_feature (29)..(29): Xaa can be any naturally occurring amino acid
  misc_feature (46)..(46): Xaa can be any naturally occurring amino acid
  misc_feature (89)..(89): Xaa can be any naturally occurring amino acid
  misc_feature (113)..(113): Xaa can be any naturally occurring amino acid
YRDMPGASCLKGSQMMRMTFTQTPGPHPXSSTPSSRPASLGYSGAXGPRPITQSELATALALASTPESSSHTPTPGTQGHSSGTSPMSXGVQSGTPITNDLFSQALQHALQAXGQPSLQSQWQPQLQQLRDMGIQDDELSLRALQATGGDIQAALELIFAGGAP

SEQ ID NO: 1312 - protein, 120 aa, Homo sapiens
  misc_feature (10)..(10): Xaa can be any naturally occurring amino acid
  misc_feature (28)..(28): Xaa can be any naturally occurring amino acid
  misc_feature (71)..(71): Xaa can be any naturally occurring amino acid
  misc_feature (95)..(95): Xaa can be any naturally occurring amino acid
LSPKHQVHTXLAVLPAPAQPPWGTVELXGPGPSPRVSWPPPWPWPALRRAALTHRLLAPRVIPQGPHQCPXVSSQGRPSPMISSAKPYSMPFRPXGSPAFRASGSPSCSSYVTWASRTMS

SEQ ID NO: 1313 - protein, 110 aa, Homo sapiens
  misc_feature (36)..(36): Xaa can be any naturally occurring amino acid
  misc_feature (53)..(53): Xaa can be any naturally occurring amino acid
  misc_feature (85)..(85): Xaa can be any naturally occurring amino acid
  misc_feature (88)..(88): Xaa can be any naturally occurring amino acid
  misc_feature (90)..(90): Xaa can be any naturally occurring amino acid
  misc_feature (105)..(105): Xaa can be any naturally occurring amino acid
GMTLGARSRCVRAALRSAGQGQGGGQLTLGDGPGPXSSTVPQGGWAGAGSTAXRVWTWCLGESHPHHLRTLQTGSPWHIPVLAGXHAXGXGINPRHWGPACFRVXNQEQW

SEQ ID NO: 1314 - protein, 225 aa, Homo sapiens
  misc_feature (139)..(139): Xaa can be any naturally occurring amino acid
  misc_feature (196)..(196): Xaa can be any naturally occurring amino acid
  misc_feature (201)..(201): Xaa can be any naturally occurring amino acid
  misc_feature (205)..(205): Xaa can be any naturally occurring amino acid
  misc_feature (220)..(220): Xaa can be any naturally occurring amino acid
FQERARIEKAYAQQLADWARKWRGTVEKGPQYGTLEKAWHAFFTAAERLSALHLEVREKPQGQDSERVRAWQRGAFHRPVLGGFRESRAAEDGFRKAQKPWLKRLKEVEASKKSYHAARKDEKTAQTRESHAKADSAVXQEQLRKLQERVERCAKEAEKTKAQYEQTLAELHRYTPRYMEDMEQAFETLQARRAPXASFLXGYAXHLTPTPGPFSAVRSXMKLHP

SEQ ID NO: 1315 - protein, 214 aa, Homo sapiens
  misc_feature (10)..(10): Xaa can be any naturally occurring amino acid
  misc_feature (14)..(14): Xaa can be any naturally occurring amino acid
  misc_feature (19)..(19): Xaa can be any naturally occurring amino acid
  misc_feature (76)..(76): Xaa can be any naturally occurring amino acid
KRSRCWCKVXSISXKKRSXWRSAGLQGLKGLFHVLHVAWSVAMQLCQRLLILSFCLLGLLGTAFHPFLQFAQLLLXDGAVCLCVALPRLGGLLILPGCVVAFLGSLNLLQPLQPGLLGLAEAVLGRPALAEAAQHRPVESPPLPGAHPLTVLPLRLLPHLQVQRAQPLSRREKGMPGLLQCAILGALLHGPPPLSGPVSQLLGISLLDAGALLE

SEQ ID NO: 1316 - protein, 163 aa, Homo sapiens
  misc_feature (2)..(2): Xaa can be any naturally occurring amino acid
  misc_feature (7)..(7): Xaa can be any naturally occurring amino acid
  misc_feature (12)..(12): Xaa can be any naturally occurring amino acid
  misc_feature (68)..(68): Xaa can be any naturally occurring amino acid
GXQHILXEKKPXALGGPARSQRLVPCPPCSVECSDAALPASAHTELLSSRPPWHSVPPVPAVCAAAPXRRRCLPLRGSPSSGRSSHPSGLRGSFSWKPQPPSASSARASGPCGSRPRPPGSRGSRPAQAGGKPPAARRAPAHCPALAASPAPPGAARSAAQPP

SEQ ID NO: 1317 - protein, 162 aa, Homo sapiens
  misc_feature (122)..(122): Xaa can be any naturally occurring amino acid
  misc_feature (130)..(130): Xaa can be any naturally occurring amino acid
  misc_feature (154)..(154): Xaa can be any naturally occurring amino acid
  misc_feature (157)..(157): Xaa can be any naturally occurring amino acid
  misc_feature (161)..(161): Xaa can be any naturally occurring amino acid
TRPFPTSPFPRQRPLPSLGPRTSSLKGQRSSQRATVQGPEGPALQEKLGSEPGWVNVAEGLSGHSGAHTLHVVGRVQANAATLQLALAPALLVLLTHLQQLLPCSEAQLISFLASVVIECPXRTPVGAFXGLSSSDHSSSCPVPGDPGTGVGGXGIXVGQXL

SEQ ID NO: 1318 - protein, 126 aa, Homo sapiens
VFLFLCVGVCQVLIHARTSHKRVLLGQNYTHPKPTPGTPKQRSGTESTAPGEAQAPLNASVTSDLPSCPQPRLVPSLPVPSLDKGPSPPWVPGLPPSRDRGAARERRFRALRVRLSRRSWALNQGG

SEQ ID NO: 1319 - protein, 215 aa, Homo sapiens
  misc_feature (203)..(203): Xaa can be any naturally occurring amino acid
  misc_feature (210)..(210): Xaa can be any naturally occurring amino acid
APPDFLRATGDRAEPSVYWAAVTLRFQMKMFESADSTATRSGQDLWAEICSCLPNPEQEDGANNAFSDSFVDSCPEGEGQREVADFAVQPAVKPWAPLQDSEVYLASLEKKLRRIKGLNQEVTSKDMLRTLAQAKKECWDRFLQEKLASEFFVDGLDSDESTLEHFKRWLQPDKVAVSTEEVQYLIPPESQVEKPVARGRTTXRGTSQQXQKQLI

SEQ ID NO: 1320 - protein, 185 aa, Homo sapiens
  misc_feature (126)..(126): Xaa can be any naturally occurring amino acid
  misc_feature (140)..(140): Xaa can be any naturally occurring amino acid
  misc_feature (166)..(166): Xaa can be any naturally occurring amino acid
  misc_feature (177)..(177): Xaa can be any naturally occurring amino acid
  misc_feature (183)..(183): Xaa can be any naturally occurring amino acid
DTEESSILIQCALGQSLHPRQSHMPAPGKSLGACSCFLCGVEIWVFSFSGFLPAAVTELHAARSGPETAARRVCVCVCVCVCVCVCVIYCSAAAGLSPAAGSSSATGFSTCDSGGIRYWTSSVLTXTLSGWSHLLKCSKXLSSESSPSTKNSEANFSWRNRSQHFXLAWAKVRSMSXEVTSDXNL

SEQ ID NO: 1321 - protein, 127 aa, Homo sapiens
  misc_feature (3)..(3): Xaa can be any naturally occurring amino acid
  misc_feature (5)..(5): Xaa can be any naturally occurring amino acid
  misc_feature (9)..(9): Xaa can be any naturally occurring amino acid
  misc_feature (16)..(16): Xaa can be any naturally occurring amino acid
  misc_feature (21)..(21): Xaa can be any naturally occurring amino acid
  misc_feature (23)..(23): Xaa can be any naturally occurring amino acid
  misc_feature (27)..(27): Xaa can be any naturally occurring amino acid
  misc_feature (34)..(34): Xaa can be any naturally occurring amino acid
  misc_feature (39)..(39): Xaa can be any naturally occurring amino acid
  misc_feature (50)..(50): Xaa can be any naturally occurring amino acid
  misc_feature (77)..(77): Xaa can be any naturally occurring amino acid
  misc_feature (91)..(91): Xaa can be any naturally occurring amino acid
NFXVXPAVXPWVPFQXSKVIXLXREEXKKNQRFXSEVTXKDMLRTLAQAXKKCWDRFLQEKLASEFFVDGLDSDESXLEHFKRWLQPDKVXVSTEEVQYLIPPESQVEKPVAEDEPAAGDKPAAAEQ

SEQ ID NO: 1322 - protein, 204 aa, Homo sapiens
LFYKGNEKKYTMSDEVFSTTLAYTKSPKVTKRTTFQDELIRAITARSARQRSSEYSDDFDSDEIVSLGDFSDTSADENSVNKKMNDFHISDDEEKNPSKLLFLKTNKSNGNITKDEPVCAIKNEEEMAPDGCEDIVVKSFSESQNKDEEFEKDKIKMKPKPRILSIKSTSSENNSLDTDDHFKPSPRPREYVEKEKSHGGRRMD

SEQ ID NO: 1323 - protein, 142 aa, Homo sapiens
  misc_feature (129)..(129): Xaa can be any naturally occurring amino acid
LKKASFFSFHFSTAVKLSFFFSATVSSSFCFFALSYSLSFLFFSLRYSIFFSFHFSKACSASPFLAAFSSSVFLLFFSSSLFLAAIFFASFSFIAFQASNDANASSLLAAFFCSFWILKFSLSILFILXISCKYTFFFSNHS

SEQ ID NO: 1324 - protein, 193 aa, Homo sapiens
  misc_feature (32)..(32): Xaa can be any naturally occurring amino acid
  misc_feature (65)..(65): Xaa can be any naturally occurring amino acid
VFEEILVLKGDSTDNYLFSLFRDFKSLGQKPXQKQSIEPDRADNIRAAVYQEWLEKKNVYLHEMXRIKRIESENLRIQNEQKKAAKREEALASFEAWKAMKEKEAKKIAAKKRLEEKNKRKTEEENAARKGEALQAFEKWKEKKMEYLKEKNRKEREYERAKKQKEEETVAEKKKDNLTAVEKWNEKKEAFFK

SEQ ID NO: 1325 - protein, 214 aa, Homo sapiens
  misc_feature (9)..(9): Xaa can be any naturally occurring amino acid
  misc_feature (200)..(200): Xaa can be any naturally occurring amino acid
KMNLPTPFXPITARPPMYEDYMPLHAPLPPTSPQPPEEPPLPDEDEELSSEESEYESTDDEDRQRMNKLMELANLQPKRPKTIKQRHVRKKRKIKDMLNTPLCPSHSLHPVLLPSDVFDQPQPVGNKRIEFHISTDMPAAFKKDLEKEQNCEEKNHDLPATEVDASNIGFGKIFPKPNLDITEEIKEDSDEMPSECISRXELGKGRISRKRNGN

SEQ ID NO: 1326 - protein, 140 aa, Homo sapiens
  misc_feature (4)..(4): Xaa can be any naturally occurring amino acid
  misc_feature (8)..(8): Xaa can be any naturally occurring amino acid
  misc_feature (13)..(13): Xaa can be any naturally occurring amino acid
  misc_feature (15)..(15): Xaa can be any naturally occurring amino acid
  misc_feature (23)..(23): Xaa can be any naturally occurring amino acid
  misc_feature (25)..(25): Xaa can be any naturally occurring amino acid
  misc_feature (29)..(29): Xaa can be any naturally occurring amino acid
  misc_feature (34)..(34): Xaa can be any naturally occurring amino acid
  misc_feature (37)..(37): Xaa can be any naturally occurring amino acid
  misc_feature (39)..(39): Xaa can be any naturally occurring amino acid
  misc_feature (46)..(46): Xaa can be any naturally occurring amino acid
  misc_feature (53)..(53): Xaa can be any naturally occurring amino acid
  misc_feature (56)..(56): Xaa can be any naturally occurring amino acid
  misc_feature (58)..(58): Xaa can be any naturally occurring amino acid
  misc_feature (61)..(61): Xaa can be any naturally occurring amino acid
  misc_feature (65)..(66): Xaa can be any naturally occurring amino acid
  misc_feature (68)..(68): Xaa can be any naturally occurring amino acid
  misc_feature (72)..(73): Xaa can be any naturally occurring amino acid
  misc_feature (75)..(75): Xaa can be any naturally occurring amino acid
  misc_feature (79)..(79): Xaa can be any naturally occurring amino acid
  misc_feature (82)..(83): Xaa can be any naturally occurring amino acid
  misc_feature (87)..(87): Xaa can be any naturally occurring amino acid
  misc_feature (90)..(90): Xaa can be any naturally occurring amino acid
  misc_feature (102)..(102): Xaa can be any naturally occurring amino acid
  misc_feature (105)..(105): Xaa can be any naturally occurring amino acid
  misc_feature (109)..(109): Xaa can be any naturally occurring amino acid
  misc_feature (112)..(113): Xaa can be any naturally occurring amino acid
  misc_feature (120)..(120): Xaa can be any naturally occurring amino acid
  misc_feature (126)..(128): Xaa can be any naturally occurring amino acid
  misc_feature (130)..(130): Xaa can be any naturally occurring amino acid
  misc_feature (138)..(138): Xaa can be any naturally occurring amino acid
  misc_feature (140)..(140): Xaa can be any naturally occurring amino acid
RSFXMKGXQNVFXKXNWKRAEFXRXEMEXLSVFXSYXPXEPNCRIXVKNLAKXVQXKXLKXIFGXXVXFSSXXQXIMFXKRXXKKGXMKXQAFIGLPNEKAXAKXLKEXNGXXLFGKPMXVQFARXXXPXQDPKEGKXKX

SEQ ID NO: 1327 - protein, 214 aa, Homo sapiens
  misc_feature (42)..(42): Xaa can be any naturally occurring amino acid
  misc_feature (56)..(56): Xaa can be any naturally occurring amino acid
  misc_feature (67)..(67): Xaa can be any naturally occurring amino acid
  misc_feature (82)..(82): Xaa can be any naturally occurring amino acid
  misc_feature (106)..(106): Xaa can be any naturally occurring amino acid
  misc_feature (117)..(117): Xaa can be any naturally occurring amino acid
  misc_feature (123)..(123): Xaa can be any naturally occurring amino acid
  misc_feature (131)..(131): Xaa can be any naturally occurring amino acid
  misc_feature (134)..(134): Xaa can be any naturally occurring amino acid
  misc_feature (179)..(180): Xaa can be any naturally occurring amino acid
  misc_feature (183)..(183): Xaa can be any naturally occurring amino acid
  misc_feature (191)..(192): Xaa can be any naturally occurring amino acid
  misc_feature (204)..(204): Xaa can be any naturally occurring amino acid
QKDYEESSWDSESLCETVSQKDVCLPKATHQKEIDKINGKLXESPDNDGFLKAPCXMKVSIPTKALXLMDMQTFKAEPPEKXSAFEPAIEMQKSVPNKALELKNEXTLRADQMFPSXSKQKKXEENSWDSXSLXETVSQKDVCVPKATHQKEMDKISGKLEDSTSLSKILDTVHSCERXXELXKDPVNNRXXKMEQMKKKFWCXEKETVRSQRS

SEQ ID NO: 1328 - protein, 86 aa, Homo sapiens
  misc_feature (3)..(3): Xaa can be any naturally occurring amino acid
  misc_feature (7)..(7): Xaa can be any naturally occurring amino acid
  misc_feature (9)..(9): Xaa can be any naturally occurring amino acid
  misc_feature (14)..(14): Xaa can be any naturally occurring amino acid
  misc_feature (29)..(29): Xaa can be any naturally occurring amino acid
  misc_feature (39)..(39): Xaa can be any naturally occurring amino acid
  misc_feature (84)..(84): Xaa can be any naturally occurring amino acid
LFXNCKXCXGFPSXLMSSRLHSIHPDLVXSLRWSAVAQXSAHCKLCLPGSRHSPATASRVVGLQAPATTPTYFFFCIFSRDGFXPC

SEQ ID NO: 1329 - protein, 77 aa, Homo sapiens
  misc_feature (3)..(3): Xaa can be any naturally occurring amino acid
  misc_feature (7)..(8): Xaa can be any naturally occurring amino acid
  misc_feature (13)..(13): Xaa can be any naturally occurring amino acid
  misc_feature (28)..(28): Xaa can be any naturally occurring amino acid
  misc_feature (38)..(38): Xaa can be any naturally occurring amino acid
VPXLQKXXRIPIXPDEQQTSFNPPRSRXVTQVECSGAXFGSLQTLPPRFTPFSCHSLPSSGTTGACHHAHLFFFLYF

SEQ ID NO: 1330 - protein, 189 aa, Homo sapiens
  misc_feature (133)..(133): Xaa can be any naturally occurring amino acid
  misc_feature (162)..(162): Xaa can be any naturally occurring amino acid
  misc_feature (167)..(167): Xaa can be any naturally occurring amino acid
  misc_feature (178)..(178): Xaa can be any naturally occurring amino acid
  misc_feature (181)..(181): Xaa can be any naturally occurring amino acid
  misc_feature (186)..(186): Xaa can be any naturally occurring amino acid
YDDDDDDWDWDEGVGKLAKGYVWNGGSNPQANRQTSDSSSAKMSTPADKVLRKFENKINLDKLNVTDSVINKVTEKSRQKEADMYRIKDKADRATVEQVLDPRTRMILFKMLTRGIITEINGCISTGKEANVXHASTANGESRAIKIYKTSILVFKDRDKYXSGEFXFRHGYCKGNPXKMXKTWAXKRK

SEQ ID NO: 1331 - protein, 126 aa, Homo sapiens
  misc_feature (15)..(15): Xaa can be any naturally occurring amino acid
ILIALLSPFAVLAWXTLASFPVLMQPFISVMIPLVNILNKIILVLGSNTCSTVALSALSLMRYISASFCLDFSVTLFMTESVTFSLSKLILFSNFRKTLSAGVDILAELLSEVCRFACGLLPPFQT

SEQ ID NO: 1332 - protein, 241 aa, Homo sapiens
  misc_feature (11)..(11): Xaa can be any naturally occurring amino acid
  misc_feature (18)..(18): Xaa can be any naturally occurring amino acid
  misc_feature (21)..(22): Xaa can be any naturally occurring amino acid
  misc_feature (24)..(24): Xaa can be any naturally occurring amino acid
  misc_feature (36)..(36): Xaa can be any naturally occurring amino acid
  misc_feature (152)..(152): Xaa can be any naturally occurring amino acid
  misc_feature (183)..(183): Xaa can be any naturally occurring amino acid
  misc_feature (191)..(191): Xaa can be any naturally occurring amino acid
  misc_feature (194)..(194): Xaa can be any naturally occurring amino acid
  misc_feature (198)..(198): Xaa can be any naturally occurring amino acid
SGCQTWPMQIXSDFNMLXPGXXVXIIDVSPVRGGRXTPHALEFLRKDCANVNDFFMRHSVAVMTVRELFEFVTDPSITHENMDAYLSKAMEIASQRTKEERSSQDHVDEEVFKRAYIPRTLNEVKNYERDMDIIMKLKEEDMAMNAQQDNIXYQTVTGLKKDLSGVQKVPALLENQVEERTCXDSEDIGSXECXDTDXEEQGDHARPKKHTTDPDIDKKERKKMVKEAQREKRKNKIPKHV

The invention claimed is:

1. A method of diagnosing prostate cancer comprising:
contacting a biological sample isolated from a subject with an antibody or antigen binding fragment thereof that specifically binds with an expression product of a nucleic acid molecule, which is (a) a nucleic acid molecule that encodes a polypeptide having at least 99% sequence identity to the amino acid sequence of SEQ ID NO: 1218, (b) a nucleic acid molecule that differs from SEQ ID NO: 504 in codon sequence due to degeneracy of the genetic code, or (c) a full length complement of (a) or (b), and
determining the interaction between the antibody or antigen binding fragment thereof and the expression product, wherein a determination that the antibody or antigen binding fragment thereof interacts with the expression product indicates that the expression product is present in the sample and that the patient has prostate cancer.

2. The method of claim 1, wherein the antibody is an antibody that binds to the expression product.

3. The method of claim 2, wherein the antibody is a polyclonal antisera or obtained from a polyclonal antisera.

4. The method of claim 2, wherein the antibody is a monoclonal antibody.

5. The method of claim 2, wherein the method is carried out as an ELISA assay.

6. The method of claim 2, wherein the method is carried out as a western blot.

7. The method of claim 2, wherein the method is carried out as an immunoprecipitation.

8. The method of claim 1, wherein the sample is a tissue sample.

9. The method of claim 8, wherein the tissue sample is a tissue biopsy.

10. The method of claim 1, wherein the sample is a cell sample.

11. The method of claim 10, wherein the cell sample is a cell scraping.

12. The method of claim 1, wherein the sample is blood or other bodily fluid.

* * * * *